US012569547B2

(12) United States Patent
Anderson et al.

(10) Patent No.: US 12,569,547 B2
(45) Date of Patent: Mar. 10, 2026

(54) IMMUNOGENIC COMPOSITIONS AGAINST CLOSTRIDIOIDES (CLOSTRIDIUM) DIFFICILE AND METHODS THEREOF

(71) Applicant: Pfizer Inc., New York, NY (US)

(72) Inventors: Annaliesa Sybil Anderson, Upper Saddle River, NJ (US); Alexey Vyacheslavovitch Gribenko, New City, NY (US); William Carl Gruber, Warwick, NY (US); Kathrin Ute Jansen, New York, NY (US); Lakshmi Khandke, Nanuet, NY (US); Nicholas Randolph Everard Kitchin, Sandwich (GB); Jody Lawrence, Lansdale, PA (US); Yahong Peng, Ambler, PA (US); Michael William Pride, Staten Island, NY (US); Christopher Frederick Webber, Sandwich (GB); Sabine Susanne Wellnitz, Nanuet, NY (US); Zhuobiao Yi, Berwyn, PA (US)

(73) Assignee: Pfizer Inc., New York, NY (US)

( * ) Notice: Subject to any disclaimer, the term of this patent is extended or adjusted under 35 U.S.C. 154(b) by 414 days.

(21) Appl. No.: 18/001,953

(22) PCT Filed: Jun. 17, 2021

(86) PCT No.: PCT/IB2021/055373
§ 371 (c)(1),
(2) Date: Dec. 15, 2022

(87) PCT Pub. No.: WO2021/255690
PCT Pub. Date: Dec. 23, 2021

(65) Prior Publication Data
US 2023/0218735 A1 Jul. 13, 2023

Related U.S. Application Data

(60) Provisional application No. 63/091,277, filed on Oct. 13, 2020, provisional application No. 63/054,316, filed on Jul. 21, 2020, provisional application No. 63/041,118, filed on Jun. 19, 2020.

(51) Int. Cl.
| | |
|---|---|
| *A61K 39/08* | (2006.01) |
| *A61K 9/19* | (2006.01) |
| *A61K 39/00* | (2006.01) |
| *A61K 47/26* | (2006.01) |
| *A61P 31/04* | (2006.01) |
| *C07K 16/12* | (2006.01) |
| *C07K 16/1282* | (2026.01) |

(52) U.S. Cl.
CPC ................ *A61K 39/08* (2013.01); *A61K 9/19* (2013.01); *A61K 47/26* (2013.01); *A61P 31/04* (2018.01); *C07K 16/1282* (2013.01); *A61K 2039/55577* (2013.01); *A61K 2039/575* (2013.01)

(58) Field of Classification Search
None
See application file for complete search history.

(56) References Cited

U.S. PATENT DOCUMENTS

| | | | |
|---|---|---|---|
| 4,689,299 | A | 8/1987 | Insel |
| 4,713,240 | A | 12/1987 | Wilkins et al. |
| 5,231,003 | A | 7/1993 | Coughlin et al. |
| 5,358,868 | A | 10/1994 | Klein et al. |
| 5,412,077 | A | 5/1995 | Siber et al. |
| 5,530,103 | A | 6/1996 | Livey et al. |
| 5,578,308 | A | 11/1996 | Capiau et al. |
| 5,582,827 | A | 12/1996 | Siber et al. |
| 5,585,089 | A | 12/1996 | Queen et al. |
| 5,599,539 | A | 2/1997 | Carroll et al. |
| 5,601,823 | A | 2/1997 | Williams et al. |
| 5,610,023 | A | 3/1997 | Deutsch |
| 5,762,934 | A | 6/1998 | Williams et al. |
| 5,773,000 | A | 6/1998 | Bostwick et al. |
| 5,814,477 | A | 9/1998 | Williams et al. |
| 5,919,463 | A | 7/1999 | Thomas et al. |
| 5,919,665 | A | 7/1999 | Williams |
| 6,083,512 | A | 7/2000 | Roberts |
| 6,214,341 | B1 | 4/2001 | Thomas et al. |
| 6,290,960 | B1 | 9/2001 | Kink et al. |
| 6,299,881 | B1 | 10/2001 | Lees et al. |
| 6,635,260 | B1 | 10/2003 | Gerding |

(Continued)

FOREIGN PATENT DOCUMENTS

| | | |
|---|---|---|
| EP | 1568378 A1 | 8/2005 |
| GB | 2 220 211 A | 1/1990 |

(Continued)

OTHER PUBLICATIONS

Almagro et al. Frontiers in Bioscience 13:1619-1633, 2008.*

(Continued)

*Primary Examiner* — Oluwatosin A Ogunbiyi
(74) *Attorney, Agent, or Firm* — Carol A. McKeever

(57) ABSTRACT

In one aspect, the invention relates to an immunogenic composition that includes a *Clostridium difficile* toxoid A and/or a *C. difficile* toxoid B, and methods of use thereof. In another aspect, the invention relates to a method for eliciting an immune response in a human against a *C. difficile* infection. The method includes administering to the human an effective dose of a composition, which includes a *C. difficile* toxoid, wherein the composition is administered at least two times, and wherein the immune response against *C. difficile* toxin A and/or toxin B is sustained.

6 Claims, 103 Drawing Sheets

Specification includes a Sequence Listing.

(56)                    References Cited

U.S. PATENT DOCUMENTS

| | | |
|---|---|---|
| 6,667,035 B1 | 12/2003 | von Eichel-Streiber |
| 6,680,168 B2 | 1/2004 | Thomas et al. |
| 6,733,760 B1 | 5/2004 | Wilkins et al. |
| 6,939,548 B2 | 9/2005 | Wilkins et al. |
| 6,969,520 B2 | 11/2005 | Thomas et al. |
| 7,037,503 B2 | 5/2006 | Collier et al. |
| 7,151,159 B2 | 12/2006 | von Eichel-Streiber |
| 7,226,597 B2 | 6/2007 | Ballard et al. |
| 7,625,559 B2 | 12/2009 | Ambrosino et al. |
| 7,750,204 B2 | 7/2010 | Kodama et al. |
| 8,420,352 B2 | 4/2013 | Oyler et al. |
| 8,444,996 B2 | 5/2013 | Schneerson et al. |
| 8,481,692 B2 | 7/2013 | Sidhu et al. |
| 8,557,548 B2 | 10/2013 | Anderson et al. |
| 8,765,399 B2 | 7/2014 | Riska |
| 8,900,597 B2 | 12/2014 | Anderson et al. |
| 9,096,653 B2 | 8/2015 | Schneerson et al. |
| 9,102,921 B2 | 8/2015 | Oyler et al. |
| 9,115,347 B2 | 8/2015 | Fang et al. |
| 9,187,536 B1 | 11/2015 | Anderson et al. |
| 9,290,565 B2 | 3/2016 | Castado et al. |
| 9,409,974 B2 | 8/2016 | Castado |
| RE46,376 E | 4/2017 | Anderson et al. |
| 9,644,024 B2 | 5/2017 | Castado |
| 9,669,083 B2 | 6/2017 | Castado |
| 9,694,063 B2 | 7/2017 | Scarselli et al. |
| 9,694,064 B2 | 7/2017 | Boutriau et al. |
| RE46,518 E | 8/2017 | Anderson et al. |
| 9,745,354 B2 | 8/2017 | Ruppen et al. |
| 10,046,040 B2 | 8/2018 | Galen |
| 10,047,404 B2 | 8/2018 | Bergeron et al. |
| 10,093,722 B2 | 10/2018 | Castado |
| 10,117,933 B2 | 11/2018 | Berry et al. |
| 10,130,694 B2 | 11/2018 | Boutriau et al. |
| 10,160,797 B2 | 12/2018 | Anderson et al. |
| 10,357,557 B2 | 7/2019 | Ellingsworth et al. |
| 10,377,816 B2 | 8/2019 | Castado |
| 10,597,428 B2 | 3/2020 | Jansen et al. |
| 10,774,117 B2 | 9/2020 | Jansen et al. |
| 10,787,652 B2 | 9/2020 | Lotvin et al. |
| 10,813,988 B2 | 10/2020 | Super et al. |
| 10,982,198 B2 | 4/2021 | Lotvin et al. |
| RE48,862 E | 12/2021 | Sidhu et al. |
| RE48,863 E | 12/2021 | Anderson et al. |
| 11,208,633 B2 | 12/2021 | Lotvin et al. |
| 11,535,652 B2 | 12/2022 | Jansen et al. |
| 2003/0044414 A1 | 3/2003 | Thoma et al. |
| 2004/0028705 A1 | 2/2004 | Ballard et al. |
| 2004/0029129 A1 | 2/2004 | Wang et al. |
| 2004/0137601 A1 | 7/2004 | von Eichel-Streiber et al. |
| 2004/0141986 A1 | 7/2004 | Parizek et al. |
| 2005/0020506 A1 | 1/2005 | Drapeau et al. |
| 2005/0106157 A1 | 5/2005 | Deckers et al. |
| 2005/0112139 A1* | 5/2005 | Karp ..................... A61P 37/00 424/188.1 |
| 2005/0202042 A1 | 9/2005 | Wilkins et al. |
| 2006/0029608 A1 | 2/2006 | Thomas et al. |
| 2007/0231336 A1 | 10/2007 | Thomas et al. |
| 2008/0248542 A1 | 10/2008 | Demain et al. |
| 2009/0087478 A1 | 4/2009 | Hansen et al. |
| 2009/0208948 A1 | 8/2009 | Paquette et al. |
| 2010/0013762 A1 | 1/2010 | Zontrop et al. |
| 2010/0167320 A1 | 7/2010 | Beernink et al. |
| 2010/0278907 A1 | 11/2010 | Bieberich |
| 2011/0045027 A1 | 2/2011 | Catchpole et al. |
| 2011/0053244 A1 | 3/2011 | Oyler et al. |
| 2011/0124109 A1 | 5/2011 | Minton et al. |
| 2011/0195086 A1 | 8/2011 | Caulfield et al. |
| 2011/0256606 A1 | 10/2011 | Fang et al. |
| 2011/0287474 A1 | 11/2011 | Riska |
| 2012/0100616 A1 | 4/2012 | Cartman et al. |
| 2012/0178643 A1 | 7/2012 | Ault-Riche et al. |
| 2012/0258126 A1 | 10/2012 | Scholler et al. |
| 2012/0269841 A1 | 10/2012 | Sidhu et al. |
| 2012/0276132 A1 | 11/2012 | Feng et al. |

| | | |
|---|---|---|
| 2012/0282293 A1 | 11/2012 | Galen |
| 2013/0004561 A1 | 1/2013 | Shone et al. |
| 2013/0005690 A1 | 1/2013 | Savidge et al. |
| 2013/0058962 A1 | 3/2013 | Shoemaker et al. |
| 2013/0244307 A1 | 9/2013 | Anderson et al. |
| 2015/0044250 A1 | 2/2015 | Heinrichs et al. |
| 2015/0056238 A1 | 2/2015 | Ellingsworth et al. |
| 2015/0125927 A1 | 5/2015 | Ruppen et al. |
| 2015/0132333 A1 | 5/2015 | Scarselli et al. |
| 2015/0291940 A1 | 10/2015 | Lotvin et al. |
| 2015/0307563 A1 | 10/2015 | Anderson et al. |
| 2015/0328209 A1 | 11/2015 | Bosse |
| 2016/0045586 A1 | 2/2016 | Hauser |
| 2016/0053221 A1 | 2/2016 | Fang et al. |
| 2016/0250283 A1 | 9/2016 | Ghose-Paul et al. |
| 2017/0165375 A1 | 6/2017 | Ashley et al. |
| 2017/0313749 A1 | 11/2017 | Jansen et al. |
| 2017/0362309 A1 | 12/2017 | Castado |
| 2018/0099039 A1 | 4/2018 | Emini et al. |
| 2019/0071714 A1 | 3/2019 | Li et al. |
| 2019/0112584 A1 | 4/2019 | Lotvin et al. |
| 2019/0202873 A1 | 7/2019 | Jansen et al. |
| 2019/0290747 A1 | 9/2019 | Ellingsworth et al. |
| 2020/0095290 A1 | 3/2020 | Jansen et al. |
| 2020/0165582 A1 | 5/2020 | Lotvin et al. |
| 2021/0024903 A1 | 1/2021 | Lotvin et al. |
| 2022/0160859 A1 | 5/2022 | Jansen et al. |

FOREIGN PATENT DOCUMENTS

| | | |
|---|---|---|
| JP | 58216123 A | 12/1983 |
| WO | 94/13264 A1 | 6/1994 |
| WO | 96/07430 A1 | 3/1996 |
| WO | 96/12802 A1 | 5/1996 |
| WO | 97/02835 A1 | 1/1997 |
| WO | 97/02836 A1 | 1/1997 |
| WO | 97/09886 A1 | 3/1997 |
| WO | 98/40100 A1 | 9/1998 |
| WO | 98/59053 A1 | 12/1998 |
| WO | 99/20304 A1 | 4/1999 |
| WO | 00/61761 A2 | 10/2000 |
| WO | 00/61762 A1 | 10/2000 |
| WO | 00/62800 A2 | 10/2000 |
| WO | 01/77319 A2 | 10/2001 |
| WO | 03/000719 A2 | 1/2003 |
| WO | 2005/069913 A2 | 8/2005 |
| WO | 2005/070458 A1 | 8/2005 |
| WO | 2006/121422 A2 | 11/2006 |
| WO | 2006/130925 A1 | 12/2006 |
| WO | 2012/163817 A2 | 12/2006 |
| WO | 2007/148091 A2 | 12/2007 |
| WO | 2008/024769 A2 | 2/2008 |
| WO | 2008/152075 A1 | 12/2008 |
| WO | 2009/035707 A1 | 3/2009 |
| WO | 2009/139919 A2 | 11/2009 |
| WO | 2009/156852 A1 | 12/2009 |
| WO | 2010/017383 A1 | 2/2010 |
| WO | 2010/0036826 A1 | 4/2010 |
| WO | 2010/063693 A1 | 6/2010 |
| WO | 2010/067262 A1 | 6/2010 |
| WO | 2010/094970 A1 | 8/2010 |
| WO | 2011/068953 A2 | 6/2011 |
| WO | 2011/126811 A2 | 10/2011 |
| WO | 2012/163810 A1 | 2/2012 |
| WO | 2012/028741 A1 | 3/2012 |
| WO | 2012/046061 A2 | 4/2012 |
| WO | 2012/143902 A1 | 10/2012 |
| WO | 2012/163811 A1 | 12/2012 |
| WO | 2013/082298 A2 | 6/2013 |
| WO | 2013/084071 A2 | 6/2013 |
| WO | 2013/112867 A1 | 8/2013 |
| WO | 2014/045226 A1 | 3/2014 |
| WO | 2014/060898 A2 | 4/2014 |
| WO | 2014/086787 A1 | 6/2014 |
| WO | 2014/096393 A1 | 6/2014 |
| WO | 2014/144567 A2 | 9/2014 |
| WO | 2014/201346 A1 | 12/2014 |
| WO | 2017/085602 A1 | 5/2017 |

(56)                References Cited

FOREIGN PATENT DOCUMENTS

WO        2018/170238 A2      9/2018
WO        2019/064115 A1      4/2019
WO        2020/201985 A1      10/2020

OTHER PUBLICATIONS

Edwards et al J. Mol. Biol. (2003) 334, 103-118.*
Matsuoka et al., Safety and immunogenicity of Clostridium difficile toxoid vaccine in Japanese adults, Jpn. J. Chemother. 65 (2): 183-191, Mar. 2017. [Japanese].
Matsuoka et al., Safety and immunogenicity of Clostridium difficile toxoid vaccine in Japanese adults, Jpn. J. Chemother. 65 (2): 183-191, Mar. 2017. [English translation].
Matsuoka et al., Safety and immunogenicity of Clostridium difficile toxoid vaccine in Japanese adults, Human Vaccines & Immunotherapeutics, 14(2):322-328 (2018).
Mann et al, "Analysis of protein phosphorylation using mass spectrometry: deciphering the phosphoproteome", Trends in Biotechnology 20(6):261-268 (2002).
McMaster-Baxter and Musher, "Clostridium difficile: Recent Epidemiologic Findings and Advances in Therapy", Pharmacotherapy, 27(7):1029-1039 (2007).
Meridian Life Science, Rabbit antibody to C. difficile Toxin B, #B01246R; Inc. URL:https://meridianlifescience.com/products/results_2.aspx?searchbox=B01246R&page=1&group=0 Jul. 2, 2014.
Metz et al, "Physicochemical and immunochemical techniques predict the quality of diptheria toxoid vaccines", Vaccine, 22(2):156-167 (2003).
Metz et al, "Identification of Formaldehyde-induced Modifications in Proteins", The Journal of Biological Chemistry, 279(8):6235-6243 (2004).
Metz et al, "Identification of Formaldehyde-Induced Modifications in Proteins: Reactions with Insulin", Bioconjugate Chem. 17(3):815-822 (2006).
Metz et al, "Quality-control issues and approaches in vaccine development", Expert Rev. Vaccines 8(2):227-238 (2009).
Michaels et al, "Polyvinyl alcohol and polyethylene glycol as protectants against fluid-mechanical injury of freely-suspended animal cells (CRL 8018)", Journal of Biotechnology 19(2-3):241-258 (1991).
Mitty et al, "Clostridium difficile Diarrhea: Pathogenesis, Epidemiology, and Treatment", The Gastroenterologist 2:61-69 (1994).
Moncrief et al, "Genetic Characterization of Toxin A-Negative, Toxin B-Positive Clostridium difficile Isolates by PCR", Journal of Clinical Microbiology, 38(8):3072-3075 (2000).
Muldrow et al, "Molecular cloning of Clostridium difficile toxin A gene fragment in lambda gtll", FEBS Letters, 213 (2):249-253 (1987).
Mulligan et al, "Elevated Levels of Serum Immunoglobulins in Asymptomatic Carriers of Clostridium difficile", Clinical Infectious Diseases 16(Suppl 4):S239-S244 (1993).
Nakajima et al, "Mechanism of Amide Formation by Carbodiimide for Bioconjugation in Aqueous Media", Bioconjugate Chem. 6(1): 123-130 (1995).
Nencioni et al, "Characterization of Genetically Inactivated Pertussis Toxin Mutants: Candidated for a New Vaccine against Whooping Cough", Infection and Immunity, 58(5):1308-1315 (1990).
Nottrott et al, "Clostridium difficile toxin A-induced apoptosis is p53-independent but depends on glucosylation of Rho GTPases", Apoptosis, 12(8):1443-1453 (2007).
Paliwal et al, "Comparison of the Conformation, Hydrophobicity, and Model Membrane Interactions of Diphtheria Toxin to Those of Formaldehyde-Treated Toxin (Diphtheria Toxoid): Formaldehyde Stabilization of the Native Conformation Inhibits Changes That Allow Membrane Insertion", Biochemistry 35(7):2374-2379 (1996).
Pasut et al, "New active poly(ethylene glycol) derivative for amino coupling", Reactive & Functional Polymers 67 (6):529-539 (2007).
Pavliakova et al, "Clostridium difficile Recombinant Toxin A Repeating Units as a Carrier Protein for Conjugate Vaccines: Studies of Pneumococcal Type 14, Escherichia coli K1, and Shigella flexneri Type 2a Polysaccharides in Mice", Infection and Immunity, 68(4):2161-2166 (2000).
Phelps et al, "Construction and Expression of the Complete Clostridium difficile Toxin A Gene in Escherichia coli", Infection and Immunity, 59(1):150-153 (1991).
Pizza et al, "Mutants of Pertussis Toxin Suitable for Vaccine Development", Science 246(4929):497-500 (1989).
Price et al, "Cloning of the Carbohydrate-binding Portion of the Toxin A Gene of Clostridium difficile", Current Microbiology, 16(1):55-60 (1987).
Prigge, "The Development of Diphtheria Vaccines", Bull. Wld Hlth Org., 13(3):473-478 (1955).
Prochazkova et al, "Structural and Molecular Mechanism for Autoprocessing of MARTX Toxin of Vibrio cholerae at Multiple Sites", The Journal of Biological Chemistry 284(39):26557-26568 (2009).
Pruitt et al, "Structure-Function Analysis of Inositol Hexakisphosphate-induced Autoprocessing in Clostridium difficile Toxin A", The Journal of Biological Chemistry, 284(33):21934-21940 (2009).
Pruitt et al, "Structural organization of the functional domains of Clostridium difficile toxins A and B", PNAS, 107 (30):13467-13472 (2010).
Puri et al, "Rational Design of Inhibitors and Activity-Based Probes Targeting Clostridium difficile Virulence Factor TcdB", Chemistry & Biology, 17(11):1201-1211 (2010).
Qa'Dan et al, "pH-Induced Conformational Changes in Clostridium difficile Toxin B", Infection and Immunity 68 (5):2470-2474 (2000).
Quemeneur et al, "Clostridium difficile Toxoid Vaccine Candidate Confers Broad Brotection against a Range of Prevalent Circulating Strains in a Nonclinical Setting", Infection and Immunity 86:6 (2018).
Rajput et al, "Adjuvant effects of saponins on animal immune responses", Journal of Zhejiang University Science B 8(3):153-161 (2007).
Rappuoli, "Toxin inactivation and antigen stabilization: two different uses of formaldehyde", Vaccine, 12(7):579-581 (1994).
Reineke et al, "Autocatalytic cleavage of Clostridium difficile toxin B", Nature, 446(7134):415-419 (2007).
Reinert et al, "Structural Basis for the Function of Clostridium difficile Toxin B", J. Mol. Biol., 351(5):973-981 (2005).
Rihn et al, "A New Purification Procedure for Clostridium Difficile Enterotoxin", Biochemical and Biophysical Research Communications, 124(3):690-695 (1984).
Robbins et al, "The Diphtheria and Pertussis Components of Diphtheria-Tetanus Toxoids-Pertussis Vaccine Should be Genetically Inactivated Mutant Toxins", The Journal of Infectious Diseases 191(1):81-88 (2005).
Robbins et al, "The rise in pertussis cases urges replacement of chemically-inactivated with genetically-inactivated toxoid for DTP", Vaccine, 25(15):2811-2816 (2007).
Roberts et al, "Modification of surface histidine residues abolishes the cytotoxic activity of Clostridium difficile toxin A", Toxicon, 39(2-3):325-333 (2001).
Robinson et al, "Tetanus Toxin: The Effect of Chemical Modifications on Toxicity, Immunogenicity, and Conformation", The Journal of Biological Chemistry 250(18):7435-7442 (1975).
Rolfe et al, "Purification and Characterization of Clostridium difficile Toxin", Infection and Immunity, 25(1):191-201 (1979).
Rothman et al, "Differential Cytotoxic Effects of Toxins A and B Isolated from Clostridium difficile", Infection and Immunity, 46(2):324-331 (1984).
Rupnik et al, "Characterization of the cleavage site and function of resulting cleavage fragments after limited proteolysis of Clostridium difficile toxin B (TcdB) by host cells", Microbiology, 151:199-208 (2005).
Rupnik, "Heterogeneity of large clostridial toxins: importance of Clostridium difficile toxinotype", FEMS Microbiol Rev, 32(3):541-555 (2008).
Rupnik, "Clostridium difficile infection: new developments in epidemiology and pathogenesis", Nature, 7(7):526-536 (2009).

(56) References Cited

OTHER PUBLICATIONS

Saif et al, "The distribution of Clostridium difficile in the environment of South Wales", Journal of Medical Microbiology 45(2):133-137 (1996).

Sakurai et al, "Carboxyl groups in Clostridium perfringens epsilon toxin", Microbial Pathogenesis, 3(6):469-474 (1987).

Salcedo et al, "Intravenous immunoglobulin therapy for severe Clostridium difficile colitis", Gut, 41(3):366-370 (1997).

Salnikova et al, "Physical Characterization of Clostridium difficile Toxins and Toxoids: Effect of the Formaldehyde Crosslinking on Thermal Stability", Journal of Pharmaceutical Sciences 97(9):3735-3752 (2008).

Sambol et al, "Toxin Gene Analysis of a Variant Strain of Clostridium difficile That Causes Human Clinical Disease", Infection and Immunity, 68(10):5480-5487 (2000).

Abdiche et al, "Determining kinetics and affinities of protein interactions using a parallel real-time label-free biosensor, the Octet", Analytical Biochemistry, 377(2):209-217 (2008).

Aboudola et al, "Clostridium difficile Vaccine and Serum Immunoglobulin G Antibody Response to Toxin A", Infection and Immunity, 71(3):1608-1610 (2003).

Ackermann et al, "Cloning and Expression of Clostridium difficile Toxin A Gene (tcdA) by PCR Amplification and the Use of an Expression Vector", Abstracts of the Interscience Conference on Antimicrobial Agents & Chemotherapy, 43rd ICAAC, Session 80(B), Abstract # B805 (2003).

Aktories, "Self-Cutting To Kill: New Insights into the Processing of Clostridium difficile Toxins", ACS Chemical Biology, 2(4):228-230 (2007).

Albesa-Jove et al, "Four Distinct Structural Domains in Clostridium difficile Toxin B Visualized Using SAXS", J. Mol. Biol., 396(5):1260-1270 (2010).

Allo et al, "Prevention of Clindamycin-Induced Colitis in Hamsters by Clostridium sordellii Antitoxin", Gastroenterology 76(2):351-355 (1979).

Alving, "Design and selection of vaccine adjuvants: animal models and human trials", Vaccine 20(Suppl 3):S56-S64 (2002).

Ananthakrishnan, "Clostridium difficile infection: epidemiology, risk factors and management", Nat. Rev. Gastroenterol. Hepatol, 8:17-26 (2011).

Anderson et al, "The Use of Esters of N-Hydroxysuccinimide in Peptide Synthesis", Journal of the American Chemical Society 86(9):1839-1842 (1964).

Anderson et al, Microbiology (Reading) 159(7):1254-1266 (2013) (Abstract only).

Anonymous: "Safety and Immunogenicity Study of GSK's Clostridium Difficile Vaccine 2904545A When Administered in Healthy Adults Aged 18-45 Years and 50-70 Years", Jul. 19, 2019, XP055851137 Cortellis.

Anonymous: "Study of a candidate Clostridium Difficile Toxoid Vaccine in Subjects at risk for C. difficile Infection", Jul. 5, 2019, pp. 1-31, XP055850657 Clinical Trials.gov.

Antunes et al, "Molecular Methods to Study Transcriptional Regulation of Clostridium difficile Toxin Genes", Methods in Molecular Biology, 646:93-115 (2010).

Aoki et al, "Mode of Action of Botulinum Neurotoxins: Current Vaccination Strategies and Molecular Immune Recognition", Critical Reviews in Immunology, 30(2):167-187 (2010).

Aslam et al, "Treatment of Clostridium difficile-associated disease: old therapies and new strategies", The Lancet Infectious Diseases, 5(9):549-557 (2005).

Aunins et al, "Vaccine Production", The Biomedical Engineering Handbook: Second Edition, Ed. Joseph D. Bronzino, CRC Press LLC, 2000.

Babcock et al, "Human Monoclonal Antibodies Directed against Toxins A and B Prevent Clostridium difficile-Induced Mortality in Hamsters", Infection and Immunity, 74(11):6339-6347 (2006).

Banno et al, "Biochemical Characterization and Biologic Actions of Two Toxins (D-1 and D-2) from Clostridium difficile", Reviews of Infectious Diseases, 6(Supp. 1):S11-S20 (1984).

Barroso et al, "Mutagenesis of the Clostridium difficile toxin B gene and effect on cytotoxic activity", Microbial Pathogenesis, 16(4):297-303 (1994).

Bartlett, "Narrative Review: The New Epidemic of Clostridium difficile-Associated Enteric Disease", Annals of Internal Medicine, 145(10):758-764 (2006).

Bartlett, "Clostridium difficile: progress and challenges", Ann. N.Y. Acad. Sci., 1213:62-69 (2010).

Basle, E., et al., "Protein Chemical Modification on Endogenous Amino Acids", Chemistry & Biology Review, 17:213-227 (2010).

Belyi et al, "Construction of a fusion protein carrying antigenic determinants of enteric clostridial toxins", FEMS Microbiology Letters, 225(2):325-329 (2003).

Bird, R.E., et al., "Single-Chain Antigen-Binding Proteins", Science, 242:423-242 (1988).

Bisseret et al, "Clostridium Difficile Toxin B: Characterization and Sequence of Three Peptides", Journal of Chromatography, 490(1):91-100 (1989).

Bobak, "The Molecular Pathogenesis of Clostridium difficile-associated Disease", Current Infectious Disease Reports, 10(2):111-115 (2008).

Bobo et al, "Sporulation and Toxin Production in Clostridium difficile", Abstracts of the Annual Meeting of the American Society for Microbiology, B-67, p. 35 (1986).

Bokori-Brown et al, Molecular basis of toxicity of Clostridium perfringens epsilon toxin, The FEBS Journal 278 (3):4589-4601 (2011).

Braun et al, "Definition of the single integration site of the pathogenecity locus in Clostridium difficile", Gene, 181 (1-2):29-38 (1996).

Brewer, "Vegetable Bacteriological Media as Substitutes for Meat Infusion Media", Journal of Bacteriology 46 (4):395-396 (1943).

Brown et al, "Construction and Characterization of Genetically Inactivated Pertussis Toxin", Symposium on Pertussis: Evaluation and Research on Acellular Pertussis Vaccines, Shizouka, Japan 1990, Develop. Biol. Standard., 73:63-73 (1991).

Burger et al, "Expression of recombinant Clostridium difficile toxin A using the Bacillus megaterium system", Biochemical and Biophysical Research Communications, 307(3):584-588 (2003).

Burns et al, "The diverse sporulation characteristics of Clostridium difficile clinical isolates are not associated with type", Anaerobe, 16(6):618-622 (2010).

Busch, "A Common Motif of Eukaryotic Glycosyltransferases is Essential for the Enzyme Activity of Large Clostridial Cytotoxins", The Journal of Biological Chemistry, 273(31):19566-19572 (1998).

Busch, "Involvement of a Conserved Tryptophan Residue in the UDP-Glucose Binding of Large Clostridial Cytotoxin Glycosyltransferases", The Journal of Biological Chemistry, 275(18):13228-13234 (2000).

Carter et al, "Defining the Roles of TcdA and TcdB in Localized Gastrointestinal Disease, Systemic Organ Damage, and the Host Response during Clostridium difficile Infections", mBio 6(3):e00551-15 (2015).

Castell, "Powdered Grass as an Enrichment Medium for Acid-Forming Anaerobes", Journal of Bacteriology 43 (4):463-471 (1942).

Castell, "Further Studies on the Use of Plant Materials as Enrichment Media For Butyric-Acid-Forming Anaerobes", Journal of Bacteriology 43(4):473-479 (1942).

CDC, "FAQs about Clostridium Difficile", http://www.cdc.gov/HAI/pdfs/cdiff/Cdiff_tagged.pdf, accessed on Sep. 26, 2013.

Chabala et al, "Carbodiimide modification reduces the conductance and increases the tetrodotoxin sensitivity in patrachotoxin-modified sodium channels", Pflugers Arch. European Journal of Physiology 421(2-3):262-269 (1992).

Chang et al, "Clindamycin-Induced Enterocolitis in Hamsters as a Model of Pseudomembranous Colitis in Patients", Infection and Immunity 20(2):526-529 (1978).

Chothia, C., et al., "Canonical Structures for the Hypervariable Regions of Immunoglobulins", J. Mol. Biol., 196:901-917 (1987).

Christodoulides et al, "Acellular pertussis vaccine prepared by a simple extraction and toxoiding procedure", Vaccine 5(3):199-207 (1987).

(56) References Cited

OTHER PUBLICATIONS

Christodoulides et al, "Optimal conditions for the toxoiding of pertussis toxin with 1-ethyl-3(3-dimethylaminopropyl) carbodiimide HC1", FEMS Microbiology Immunology 47:425-436 (1989).

Cohen et al, "Analysis of the Pathogenicity Locus in *Clostridium difficile* Strains", The Journal of Infectious Diseases, 181(2):659-663 (2000).

Corthier et al, "Protection against Experimental Pseudomembranous Colitis in Gnotobiotic Mice by Use of Monoclonal Antibodies against Clostridium difficile Toxin A", Infection and Immunity 59(3):1192-1195 (1991).

Coyle et al, "Reactivity of Clostridium difficile Toxinotypes with the illumigene ™ C. difficile Molecular Assay" poster presented at the 110th General Meeting of the American Society for Microbiology, Poster Board No. 219, http://www.meridianbioscience.com/Content/Assets/Files/2.1%20%20C.%20difficile%20Products/illumigene%20C.%20difficile/illumigene%20technology%20page/ASM_Abstract_2.pdf—Date accessed Apr. 4, 2011.

D'Auria et al, "In Vivo Physiological and Transcriptional Profiling Reveals Host Responses to Clostridium difficile Toxin A and Toxin B", Infection and Immunity 81(10):3814-3824 (2013).

Database Geneseq [Online], Feb. 21, 2008, "Clostridium difficile toxin B protein", XP002718659, retrieved from EBI accession No. GSP:AOG16927.

Database Geneseq [Online], Apr. 26, 2012, "Clostridium difficile strain 630 trdA protein SEQ:6.", XP002718658, retrieved from EBI accession No. Gsp: AZU07697.

Daubener et al, "Clostridium difficile Toxins A and B Inhibit Human Immune Response In Vitro", Infection and Immunity, 56(5):1107-1112 (1988).

Davis et al, "Antisera specificities to 1-ethyl-3-(3-dimethylaminopropyl) carbodiimide adducts of proteins", Immunology 53(3):435-41 (1984).

De Bruyn et al., "Defining the optimal formulation and schedule of a candidate toxoid vaccine against Clostridium difficile infection: A randomized Phase 2 clinical trial", Vaccine 34(19):2170-2178 (2016).

Demarest et al, "Neutralization of Clostridium difficile toxin A using antibody combinations", mAbs, 2(2):190-198 (2010).

Demarest, SJ, et al., "Structural Characterization of the Cell Wall Binding Domains of Clostridium difficile Toxins A and B; Evidence that Ca2+ Plays a Role in Toxin A Cell Surface Association", J. Mol. Biol., 346:1197-1206 (2005).

Deneve et al, "New trends in Clostridium difficile virulence and pathogenesis", International Journal of Antimicrobial Agents, 33(S1):S24-S28 (2009).

Devi et al., Antibodies to poly[(2-8)-alpha-N-acetylneuraminic acid] and poly[(2-9)-alpha-N-acetylneuraminic acid] are elicited by immunization of mice with *Escherichia coli* K92 conjugates: potential vaccines for groups B and C meningococci and *E. coli* K1. Proc Natl Acad Sci U S A. Aug. 15, 1991 88(16):7175-9.

Doern et al, "Laboratory Diagnosis of Clostridium difficile-Associated Gastrointestinal Disease: Comparison of a Monoclonal Antibody Enzyme Immunoassay for Toxins A and B with a Monoclonal Antibody Enzyme Immunoassay for Toxin A Only and Two Cytotoxicity Assays", Journal of Clinical Microbiology, 30(8):2042-2046 (1992).

Donald et al, "A novel approach to generate a recombinant toxoid vaccine against Clostridium difficile", Microbiology 159(Pt. 7):1254-1266 (2013).

Donta et al, "Effects of Clostridium difficile Toxin on Tissue-Cultured Cells", The Journal of Infectious Diseases, 141 (2):218-222 (1980).

Donta et al, "Differential Effects of Clostridium difficile Toxins on Tissue-Cultured Cells", Journal of Clinical Microbiology, 15(6):1157-1158 (1982).

Donta et al, "Recombinant Polypeptide of C. difficile Toxin B that Inhibits Toxin Activity", Abstracts of the 96th General Meeting of the American Society for Microbiology, B-22, p. 158 (1996).

Dupuy et al, "Regulated transcription of Clostridium difficile toxin genes", Molecular Microbiology, 27(1):107-120 (1998).

Ebright et al, "Evaluation of Eight Cephalosporins in Hamster Colitis Model", Antimicrobial Agents and Chemotherapy, 19(6):980-986 (1981).

Egerer et al, "Auto-catalytic Cleavage of Clostridium difficile Toxins A and B Depends on Cysteine Protease Activity", The Journal of Biological Chemistry, 282(35):25314-25321 (2007).

Egerer et al, "Autocatalytic Processing of Clostridium difficile Toxin B", The Journal of Biological Chemistry, 284 (6):3389-3395 (2009).

El-Faham et al, "Peptide Coupling Reagents, More than a Letter Soup", Chemical Reviews 111(11):6557-6602 (2011).

Fang et al, "Production of Clostridium difficile toxin in a medium totally free of both animal and dairy proteins or digests", Proc Natl Acad Sci USA, 106(32):13225-13229 (2009).

Faust et al, "The Enzymatic Domain of Clostridium difficile Toxin A is Located within its N-Terminal Region", Biochemical and Biophysical Research Communications, 251(1):100-105 (1998).

Fekety et al, "Diagnosis and Treatment of Clostridium difficile Colitis", Journal of the American Medical Association 269(1):71-75 (1993).

Fernie et al, "Active and Passive Immunization to Protect Against Antibiotic Associated Caecitis in Hamsters", International Symposium on Enteric Infections in Man and Animals: Standardization of Immunological Procedures, Dublin, Ireland, 1982, Develop. biol. Standard, 53:325-332 (1983).

Fischer, "Amine Coupling Through EDC/NHS: A Practicle Approach", Surface Plasmon Resonance, Chapter 3, 627:55-73 (2010).

Fitzgerald, Clostridium difficile Toxin A antibody, #70-CR66; URL: http://www.fitzgerald-fii.com/clostridium-difficile-toxin-a-antibody-70-cr66.html.

Fluit et al, "Nontoxigenic Strains of Clostridium difficile Lack the Genes for Both Toxin A and Toxin B", Journal of Clinical Microbiology, 29(11):2666-2667 (1991).

Gardiner et al, "A DNA vaccine targeting the receptor-binding domain of Clostridium difficile toxin A", Vaccine, 27 (27):3598-3604 (2009).

Genisyuerek et al, "Structural determinants for membrane insertion, pore formation and translocation of Clostridium difficile toxin B", Molecular Microbiology 79(6):1643-1654 (2011).

Genth et al, "New Method To Generate Enzymatically Deficient Clostridium difficile Toxin B as an Antigen for Immunization", Infection and Immunity, 68(3):1094-1101 (2000).

Genth et al, "Clostridium difficile toxins: More than mere inhibitors of Rho proteins", The International Journal of Biochemistry & Cell Biology, 40(4):592-597 (2008).

Gerding et al, "Treatment of Clostridium difficile Infection", Clinical Infectious Diseases, 46(Suppl):S32-S42 (2008).

Gerding et al, "Advances in pathogenesis, diagnosis and management of CDI", Nat. Rev. Gastroenterol. Hepatol., 8 (2):67-68 (2011).

Gerding, "Clostridium difficile Infection Prevention: Biotherapeutics, Immunologics, and Vaccines", Discovery Medicine 13(68):75-83 (2012).

Gerhard et al, "Comparison of wild type with recombinant Clostridium difficile toxin A", Microbial Pathogenesis, 38 (2-3):77-83 (2005).

Gersch et al, "Disarming Clostridium difficile", Chemistry & Biology, 17(11):1165-1166 (2010).

Ghose et al, "Transcutaneous Immunization with Clostridium difficile Toxoid A Induces Systemic and Mucosal Immune Responses and Toxin A-Neutralizing Antibodies in Mice", Infection and Immunity, 75(6):2826-2832 (2007).

Giannasca et al, "Serum Antitoxin Antibodies Mediate Systemic and Mucosal Protection from Clostridium difficile Disease in Hamsters", Infection and Immunity 67(2):527-538 (1999).

Giannasca et al, "Active and passive immunization against Clostridium difficile diarrhea and colitis", Vaccine, 22 (7):848-856 (2004).

Giesemann et al, "Processing of Clostridium difficile Toxins", Journal of Medical Microbiology, 57:690-696 (2008).

Gouliouris et al, "Prevention and treatment of Clostridium difficile infection", Clinical Medicine, 11(1):75-79 (2011).

Grabarek et al, "Zero-Length Crosslinking Procedure with the Use of Active Esters", Analytical Biochemistry 185 (1):131-135 (1990).

(56) References Cited

OTHER PUBLICATIONS

Greenberg et al, "Phase I dose finding studies of an adjuvanted Clostridium difficile toxoid vaccine", Vaccine 30 (13):2245-2249 (2012).

Greenhill, "The importance of toxin A is re-established in Clostridium difficile infection", Nature Reviews: Gastroenterology & Hepatology, 7(12):654 (2010).

Greenspan et al, "Defining epitopes: It's not as easy as it seems", Nature Biotechnology, 17(10):936-937 (1999).

Gribenko, et al, "Development of a subunit vaccine for prevention of Clostridium difficile associated diseases: Biophysical characterization of toxoids A and B", Biochemistry and Biophysics Reports, 9:193-202 (2017).

Gupta et al, "Adjuvants for human vaccines—current status, problems and future prospects", Vaccine 13 (14):1263-1276 (1995).

Gurwith et al, "Morphologic and functional effects of Clostridium difficile enterotoxin in tissue culture", Canadian Journal of Microbiology, 28(1):100-105 (1982).

Guttenberg et al, "Clostridial Glucosylating Toxins: Inositol Hexakisphosphate-Dependent Processing of Clostridium Sordellii Lethal Toxin and Clostridium Novyi α-Toxin", Journal of Biological Chemistry, 286 (17):14779-14786 (2011).

Haslam et al, "Growth of Clostridium difficile and production of toxins A and B in complex and defined media", J Med Microbiol, 21(4):293-297 (1986).

Heap et al, "The ClosTron: A universal gene knock-out system for the genus Clostridium", Journal of Microbiological Methods, 70(3):452-464 (2007).

Heap et al, "A modular system for Clostridium shuttle plasmids", Journal of Microbiological Methods, 78(1):79-85 (2009).

Heap et al, "The ClosTron: Mutagenesis in Clostridium refined and streamlined", Journal of Microbiological Methods 30(1):49-55 (2010).

Wolfhagen et al, "Toxins A and B of Clostridium difficile", FEMS Microbiology Reviews, 13(1):59-64 (1994).

Woody et al, "Modification of Carboxyl Groups in Botulinum Neurotoxin Types A and E", Toxicon 27(10):1143-1150 (1989).

Wren et al, "Molecular cloning and expression of Clostridium difficile toxin A in Escherichia coli K12", FEBS Letters, 225(1-2):82-86 (1987).

Xie et al, "Development and Optimization of a Novel Assay To Measure Neutralizing Antibodies against Clostridium difficile Toxins", Clinical and Vaccine Immunology, 20(4): 517-525 (2013).

Yang et al, "Expression of recombinant Clostridium difficile toxin A and B in Bacillus megaterium", BMC Microbiology, 8:192 (2008).

Zeitlin et al, "Preventing infectious disease with passive immunization", Microbes and Infection 2(6):701-708 (2000).

PCT International Search Report and Written Opinion for International Application No. PCT/IB2021/055373 mailed on Dec. 13, 2021.

Sambol et al, "Infection of Hamsters with Epidemiologically Important Strains of Clostridium difficile", The Journal of Infectious Diseases, 183(12):1760-1766 (2001).

Sarkar et al, "Selection of Adjuvants for Vaccines Targeting Specific Pathogens", Expert Review of Vaccines, 18 (5):505-521 (2019).

Sauerborn et al, "The C-terminal ligand-binding domain of Clostridium difficile toxin A (TcdA) abrogates TcdA-specific binding to cells and prevents mouse lethality", FEMS Microbiology Letters, 155(1):45-54 (1997).

Schmidt et al, "Clostridium difficile Toxin as a Confounding Factor in Enterovirus Isolation", Journal of Clinical Microbiology, 12(6):796-798 (1980).

Sebaihia et al, "The multidrug-resistant human pathogen Clostridium difficile has a highly mobile, mosaic genome", Nature Genetics, 38(7):779-786 (2006).

Sheehan et al, "The Use of Water-Soluble and Basic Carbodiimides in Peptide Synthesis", The Journal of Organic Chemistry 21(4):439-441 (1956).

Sheldon et al, "A phase 1, placebo-controlled, randomized study of the safety, tolerability, and immunogenicity of a Clostridium difficile vaccine administered with or without aluminum hydroxide in healthy adults", Vaccine 34 (18):2082-2091 (2016).

Shen et al, "Defining an allosteric circuit in the cysteine protease domain of Clostridium difficile toxins", Nature Structural & Molecular Biology, 18(3):364-372 (2011).

Smith, "Botulism and vaccines for its prevention", Vaccine, 27(Suppl 4):D33-D39 (2009).

Song et al, "Molecular analysis of the promoter region of the Clostridium difficile toxin B gene that is functional in Escherichia coli", J. Med. Microbiol., 47(4):309-316 (1998).

Sougioultzis et al, "Bacterial infections: small intestine and colon", Current Opinion in Gastroenterology, 19 (1):23-30 (2003).

Sougioultzis et al, "Clostridium difficile Toxoid Vaccine in Recurrent C. difficile-Associated Diarrhea", Gastroenterology, 128(3):764-770 (2005).

Spyres et al, "Deletion Analysis of the Clostridium difficile Toxin B Glucosylation Domain", Abstracts of the 101st General Meeting of the American Society for Microbiology, Session No. 156/B. Abstract B-238 (2001).

Spyres et al, "Mutational Analysis of the Enzymatic Domain of Clostridium difficile Toxin B Reveals Novel Inhibitors of the Wild-Type Toxin", Infection and Immunity, 71(6):3294-3301 (2003).

Stabler et al, "Comparative genome and phenotypic analysis of Clostridium difficile 027 strains provides insight into the evolution of a hypervirulent bacterium", Genome Biology, 10(9)Article R102:R102-R102.15 (2009).

Staros et al, "Enhancement by N-Hydroxysulfosuccinimide of Water-Soluble Carbodiimide-Mediated Coupling Reactions", Analytical Biochemistry 156(1):220-222 (1986).

Steele et al, "Systemic Dissemination of Clostridium difficile Toxins A and B Is Associated With Severe, Fatal Disease in Animal Models", The Journal of Infectious Diseases 205(3):384-391 (2012).

Steele et al, "Antibody Against TcdB, but Not TcdA, Prevents Development of Gastrointestinal and Systemic Clostridium difficile Disease", The Journal of Infectious Diseases 207(2);323-330 (2013).

Sun et al, "Essential role of the glucosyltransferase activity in Clostridium difficile toxin-induced secretion of TNF-α by macrophages", Microbial Pathogenesis, 46(6):298-305 (2009).

Sunenshine, et al, "Clostridium Difficile-Associated Disease: New Challenges from an Established Pathogen", Cleveland Clinic Journal of Medicine, 73(2):187-197 (2006).

Tachovsky et al, "Toxin Production and Plasmid DNA in Clostridium-difficile", Abstracts of the Annual Meeting of the American Society for Microbiology, B134 (1984).

Tang et al, "One-Step Cloning and Expression of Clostridium difficile Toxin B Gene (tcdB)", Abstracts of the Interscience Conference on Antimicrobial Agents & Chemotherapy, 41st ICAAC Abstracts, Session 98(B), Abstract #B-970 (2001).

Tang et al, "Identification of alternative products and optimization of 2-nitro-5-thiocyanatobenzoic acid cyanylation and cleavage at cysteine residues", Analytical Biochemistry 334:48-61 (2004).

Tang-Feldman et al, "One-step cloning and expression of Clostridium difficile toxin B gene (tcdB)", Molecular and Cellular Probes, 16(3):179-183 (2002).

Taylor et al, "Comparison of Two Toxins Produced by Clostridium difficile", Infection and Immunity, 34(3):1036-1043 (1981).

Teichert et al, "Application of Mutated Clostridium difficile Toxin A for Determination of Glucosyltransferase-Dependent Effects", Infection and Immunity, 74(10):6006-6010 (2006).

Thaysen-Anderson et al, "Investigation of the detoxification mechanism of formaldehyde-treated tetanus toxin", Vaccine 25(12):2213-2227 (2007).

Thermo Scientific Pierce Crosslinking Technical Handbook, © 2009 Thermo Fisher Scientific Inc., www.piercenet.com/Files/1601673_Crosslink_HB_Intl.pdf, Date accessed Mar. 23, 2011.

Tian et al, "A novel fusion protein containing the receptor binding domains of C. difficile toxin A and toxin B elicits protective immunity against lethal toxin and spore challenge in preclinical efficacy models", Vaccine 30:4249-4258 (2012).

Timkovich, "Detection of the Stable Addition of Carbodiimide to Proteins", Analytical Biochemistry 79(1-2):135-143 (1977).

Toma et al, "Serotyping of Clostridium difficile", Journal of Clinical Microbiology, 26(3):426-428 (1988).

(56)  References Cited

OTHER PUBLICATIONS

Torres et al, "Evaluation of Formalin-Inactivated Clostridium difficile Vaccines Administered by Parenteral and Mucosal Routes of Immunization in Hamsters", Infection and Immunity, 63(12):4619-4627 (1995).

Torres et al, "Antigenicity of amino-acid sequences from Clostridium difficile toxin B", J. Med. Microbiol., 44 (6):464-474 (1996).

Torres et al, "Clostridium difficile Vaccine: Influence of Different Adjuvants and Routes of Immunization on Protective Immunity in Hamsters", Vaccine Research, 5(3):149-162 (1996).

Underwood, et al, "Characterization of the Sporulation Initiation Pathway of Clostridium difficile and Its Role in Toxin Production", Journal of Bacteriology, 191(23):7296-7305 (2009).

Vidunas, et al, "Production and Characterization of Chemically Inactivated Genetically Engineered Clostridium Difficile Toxoids", Journal of Pharmaceutical Science, 105:2032-2041 (2016).

Viswanathan et al, "Clostridium difficile infection—An Overview of the disease and its pathogenesis, epidemiology and interventions", Gut Microbes, 1(4):234-242 (2010).

Von Eichel-Streiber et al, "Cloning and Characterization of Overlapping DNA Fragments of the Toxin A Gene of Clostridium difficile", Journal of General Microbiology, 135(1):55-64 (1989).

Von Eichel-Streiber et al, "Cloning of Clostridium difficile toxin B gene and demonstration of high N-terminal homology between toxin A and B", Med Microbiol Immunol, 179(5):271-279 (1990).

Von Eichel-Streiber et al, "A nonsense mutation abrogates production of a functional enterotoxin A in *Clostridium difficile* toxinotype VIII strains of serogroups F and X", FEMS Microbiology Letters, 178(1):163-168 (1999).

Voth et al, "Clostridium difficile Toxins: Mechanism of Action and Role in Disease", Clinical Microbiology Reviews, 18 (2):247-263 (2005).

Ward et al, "Immunogenicity of a *Salmonella typhimurium* aroA aroD Vaccine Expressing a Nontoxic Domain of Clostridium difficile Toxin A", Infection and Immunity, 67(5):2145-2152 (1999).

Ward et al, "Binding activities of a repertoire of single immunoglobulin variable domains secreted from *Escherichia coli*", Nature, 341:544-546 (1989).

Ward et al, "Local and Systemic Neutralizing Antibody Responses Induced by Intranasal Immunization with the Nontoxic Binding Domain of Toxin A from Clostridium difficile", Infection and Immunity, 67(10):5124-5132 (1999).

Warny et al, "Human Antibody Response to Clostridium difficile Toxin A in Relation to Clinical Course of Infection", Infection and Immunity, 62(2):384-389 (1994).

Warny et al, "Gamma Globulin Administration in Relapsing Clostridium Difficile-Induced Pseudomembranous Colitis with a Defective Antibody Response to Toxin A", Acta Clinica Belgica 50:36-39 (1995).

Wilchek et al, "Limitations of N-Hydroxysuccinimide Esters in Affinity Chromatography and Protein Immobilization", Biochemistry 26(8):2155-2161 (1987).

Wilkins et al, "Clostridium difficile Testing: after 20 Years, Still Challenging", Journal of Clinical Microbiology, 41 (2):531-534 (2003).

Williamson et al, "Mass Spectrometric Analysis of Multiple Pertussis Toxins and Toxoids", Journal of Biomedicine and Biotechnology vol. 2010, Article ID 942365, 9 pages (2010).

Willis et al, "Confirmation that the Latex-Reactive Protein of Clostridium difficile Is a Glutamate Dehydogenase", Journal of Clinical Microbiology, 30(5):1363-1364 (1992).

Henderson et al, "A Review of the Safety and Efficacy of Vaccines as Prophylaxis for Clostridium difficile Infections", Vaccines 5, 25/9 pages (2017).

Hoare et al, "A Method for the Quantitative Modification and Estimation of Carboxylic Acid Groups in Proteins", The Journal of Biological Chemistry 242(10)2447-2453 (1967).

Hofmann et al, "Localization of the Glucosyltransferase Activity of Clostridium difficile Toxin B to the N-terminal Part of the Holotoxin", The Journal of Biological Chemistry, 272(17):11074-11078 (1997).

Holden et al, "Effects of Helminthosporium maydis Race T Toxin on Electron Transport in Susceptible Corn Mitochondria and Prevention of Toxin Actions by Dicyclohexylcarbodiimide", Plant Physiol. 91(4):1296-1302 (1989).

Hundsberger et al, "Transcription analysis of the genes tcdA-E of the pathogenicity locus of Clostridium difficile", Eur. J. Biochem., 244(3):735-742 (1997).

Hunter, "Overview of vaccine adjuvants: present and future", Vaccine 20(Suppl 3):S7-S12 (2002).

Hussack et al, "Neutralization of Clostridium difficile Toxin A with Single-Domain Antibodies Targeting the Cell-Receptor Binding Domain", Journal of Biological Chemistry, 286(11):8961-8976 (2011).

Huston, J.S., et al., "Protein engineering of antibody binding sites: Recovery of specific activity in an anti-digoxin single-chain Fv analogue produced in *Escherichia coli*", Proc. Natl. Acad. Sci., 85:5879-5883 (1988).

Jank et al, "Change of the Donor Substrate Specificity of Clostridium difficile Toxin B by Site-directed Mutagenesis", The Journal of Biological Chemistry, 280(45):37833-37838 (2005).

Jank et al, "Clostridium difficile Glucosyltransferase Toxin B-essential Amino Acids for Substrate Binding", The Journal of Biological Chemistry, 282(48):35222-35231 (2007).

Jank et al, "Structure and mode of action of clostridial glucosylating toxins: the ABCD model", Trends in Microbiology, 16(5):222-229 (2008).

Jansen, et al, "A novel approach to a C. difficile toxoid vaccine: immunogenicity andpreclinical efficacy" Abstract O2. In: Presented at the 4th international Clostrid-ium difficile symposium (2012).

Johnson, "Systemic and Mucosal Antibody Responses to Toxin A in Patients Infected with Clostridium difficile", The Journal of Infectious Diseases 166:1287-1294 (1992).

Johnson, "Antibody Responses to Clostridial Infection in Humans", Clinical Infectious Diseases, 25(Suppl 2):S173-S177 (1997).

Jones et al, "An improved method for development of toxoid vaccines and antitoxins", Journal of Immunological Methods, 337(1):42-48 (2008).

Kang et al, "Development of a stabilizer for lyophilization of an attenuated duck viral hepatitis vaccine", Poultry Science 89(6):1167-1170 (2010).

Karberg et al, "Group II introns as controllable gene targeting vectors for genetic manipulation of bacteria", Nature Biotechnology, 19(2):1162-1167 (2001).

Karlsson et al, "Supression of Toxin Production in C. difficile by Amino Acids", Abstracts of the 99th General Meeting of the American Society for Microbiology, Session No. 55/Abstract L-4 (1999).

Kato et al, "Deletions in the repeating sequences of the toxin A gene of toxin A-negative, toxin B-positive Clostridium difficile strains", FEMS Microbiology Letters, 175(2):197-203 (1999).

Kayser et al, "Disruption of Bacterial Genes Using Retargeted Group II Introns", Sigma-Aldrich Poster, http://www.sigmaaldrich.com/etc/medialib/docs/Sigma/General_Information/2/groupIIintronskarberg.pdf, Date accessed Sep. 12, 2010.

Kelly, "Anti-Clostridium difficile Bovine Immunoglobulin Concentrate Inhibits Cytotoxicity and Enterotoxicity of C. difficile Toxins", Antimicrobial Agents and Chemotherapy 40(2):373-379 (1996).

Kelly, "Immune response to Clostridium difficile infection", European Journal of Gastroenterology & Hepatology, 8 (11):1048-1053 (1996).

Kelly et al, "The host immune response to Clostridium difficile", Journal of Medical Microbiology, 60:1070-1079 (2011).

Ketley et al, "Sporogenesis and toxin A production by Clostridium difficile", J. Med. Microbiol., 22(1):33-38 (1986).

Kim et al, "Immunization of Adult Hamsters against Clostridium difficile-Associated Ileocecitis and Transfer of Protection to Infant Hamsters", Infection and Immunity, 55(12):2984-2992 (1987).

Kink et al, "Antibodies to Recombinant Clostridium difficle Toxins A and B Are an Effective Treatment and Prevent Relapse of C. difficile-Associated Disease in a Hamster Model of Infection", Infection and Immunity, 66(5):2018-2025 (1998).

(56) References Cited

OTHER PUBLICATIONS

Klipstein et al, "Development of a vaccine of cross-linked heat-stable and heat-labile enterotoxins that protects against *Escherichia coli* producing either enterotoxin", Infection and Immunity 37(2):550-557 (1982).

Kohler, G., et al., "Continuous cultures of fused cells secreting antibody of predefined specificity", Nature, 256:495-497 (1975).

Kotloff et al, "Safety and Immunogenicity of Increasing Doses of a Clostridium difficile Toxoid Vaccine Administered to Healthy Adults", Infection and Immunity, 69(2): 988-995 (2001).

Kreimeyer et al, "Autoproteolytic cleavage mediates cytotoxicity of Clostridium difficile toxin A", Naunyn-Schmiedeberg's Archives of Pharmacology, 383(3):253-262 (2011).

Kuehne et al, "The role of toxin A and toxin B in Clostridium difficile infection", Nature, 467(7316):711-714 (2010).

Kunkel et al, "Contact-site cross-linking agents", Molecular and Cellular Biochemistry 34(1):3-13 (1981).

Kyne et al, "Prospects for a Vaccine for Clostridium difficile", BioDrugs, 10(3):173-181 (1998).

Kyne et al, "Association between antibody response to toxin A and protection against recurrent Clostridium difficile diarrhoea", The Lancet, 357(9251):189-193 (2001).

Lancaster et al, "An assessment of thermal stability of Clostridium difficile toxoid formulations", Human Vaccines, 7 (2):202-210 (2011).

Lanis et al, "Variations in TcdB Activity and the Hypervirulence of Emerging Strains of Clostridium difficile", Plos Pathogens, 6(8):e1001061 (pp. 1-11) (2010).

Letourneur et al, "Molecular cloning, overexpression in *Escherichia coli*, and purification of 6x his-tagged C-terminal domain of Clostridium difficile toxins A and B", Protein Expression & Purification, 31(2):276-285 (2003).

Leung et al, "Treatment with intravenously administered gamma globulin of chronic relapsing colitis induced by Clostridium difficile toxin", The Journal of Pediatrics 118:633-637 (1991).

Liang, A.C., et al., "Fast-dissolving intraoral drug delivery systems", Expert Opin. Ther. Patents, 11(6):981-986 (2001).

Libby et al, "Production of Antitoxins to Two Toxins of Clostridium difficile and Immunological Comparison of the Toxins by Cross-Neutralization Studies", Infection and Immunity, 35(1):374-376 (1982).

Libby et al, "Effects of the Two Toxins of Clostridium difficile in Antibiotic-Associated Cecitis in Hamsters," Infection and Immunity, 36(2):822-829 (1982).

Lonnroth et al, "Toxin A of Clostridium Difficile: Production, Purification and Effect in Mouse Intestine", Acta Pathologica, Microbiologica, et Immunologica Scandinavica—Section B, Microbiology, 91(6):395-400 (1983).

Lopez-Alonso et al, "Carbodiimide EDC Induces Cross-Links That Stabilize Rnase A C-Dimer against Dissociation: EDC Adducts Can Affect Protein Net Charge, Conformation, and Activity", Bioconjugate Chem. 20(8):1459-1473 (2009).

Lowy et al, "Treatment with Monoclonal Antibodies against Clostridium difficile Toxins", The New England Journal of Medicine, 362(3):197-205 (2010).

Lyerly et al, "Biological Activities of Toxins A and B of Clostridium difficile", Infection and Immunity, 35(3):1147-1150 (1982).

Lyerly et al, "Vaccination against Lethal Clostridium difficile Enterocolitis with a Nontoxic Recombinant Peptide of Toxin A", Current Microbiology, 21(1):29-32 (1990).

Lyerly et al., "Passive Immunization of Hamsters against Disease Caused by Clostridium difficile by Use of Bovine Immunoglobulin G Concentrate", Infection and Immunity 59(6):2215-2218 (1991).

Lyerly et al, "Multicenter Evaluation of the Clostridium difficile TOX A/B TEST", Journal of Clinical Microbiology 36 (1):184-190 (1998).

Lyras et al, "Toxin B is essential for virulence of Clostridium difficile", Nature, 458(7242):1176-1179 (2009).

Malorni et al, "Enhancement of Cell-Mediated Cytotoxicity by Clostridium Difficile Toxin A: An In Vitro Study", Toxicon, 29(4/5):417-428 (1991).

* cited by examiner

FIG. 1

>TcdA001
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNIIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALISYKIINGKHFYNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM

FIG. 1 (continued)

QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 762)

>TcdA002
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTIINGKHFYFNTDGIMQ

FIG. 1 (continued)

IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTDANNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 763)

>TcdA003
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGNKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKGIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF

FIG. 1 (continued)

NSENELDRDHLGFKIIDNKTYYYDEDSKLVKGLININNSLFYFDPIEFNLVTGWQTINGK
KYYFDINTGAALTSYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDDNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 764)

>TcdA004
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN

FIG. 1 (continued)

LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPNTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYFNNDGVMQLGVFKGPDGFEYFAPANTQNNNIEGQAI
VYQSKFLTLNGKKYYFDNNSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTDANNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 765)

>TcdA005
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQGLLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT

FIG. 1 (continued)

VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNIIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALISYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 766)

\>TcdA007
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
PRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS

FIG. 1 (continued)

IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKEYGPLKT
EDDKILVPIDDLVISEIDFNNNSIKLGTCNILAMEGGSGHTVTGNIDHFFSSPYISSHIP
SLSVYSAIGIKTENLDFSKKIMMLPNAPSRVFWWETGAVPGLRSLENNGTKLLDSIRDLY
PGKFYWRFYAFFDYAITTLKPVYEDTNTKIKLDKDTRNFIMPTITTDEIRNKLSYSFDGA
GGTYSLLLSSYPISMNINLSKDDLWIFNIDNEVREISIENGTIKKGNLIEDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLNNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIESNLVTGWQTINGK
KYYFDINTGAASTSYKIINGKHFYFNNNGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTSIASTGYTIINGKYFYFNTDGIMQ
IGVFKVPNGFEYFAPANTHNNNIEGQAILYQNKFLTLNGKKYYFGSDSKAITGWQTIDGK
KYYFNPNNAIAATHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDSKKYYFNL
NTAVAVTGWQTIDGEKYYFNLNTAEAATGWQTIDGKRYYFNTNTYIASTGYTIINGKHFY
FNTDGIMQIGVFKGPDGFEYFAPANTHNNNIEGQAILYQNKFLTLNGKKYYFGSDSKAVT
GLRTIDGKKYYFNTNTAVAVTGWQTINGKKYYFNTNTYIASTGYTIISGKHFYFNTDGIM
QIGVFKGPDGFEYFAPANTDANNIEGQAIRYQNRFLYLHDNIYYFGNDSKAATGWATIDG
NRYYFEPNTAMGANGYKTIDNKNFYFRNGLPQIGVFKGPNGFEYFAPANTDANNIDGQAI
RYQNRFLHLLGKIYYFGNNSKAVTGWQTINSKVYYFMPDTAMAAAGGLFEIDGVIYFFGV
DGVKAPGIYG* (SEQ ID NO: 767)

>TcdA008
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS

FIG. 1 (continued)

KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTIINGKHFYFNTDGIMK
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTYNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 768)

FIG. 1 (continued)

>TcdA009
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYNNDGVMQLGVFKGPDGFEYFAPANTQNNNIEGQAI
VYQSKFLTLNGKKYYFDNNSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTDANNIEGQAILYQNKFLTLNGKKYYFGSDSKAVT
GLRTIDGKKYYFNTNTAVAVTGWQTINGKKYYFNTNTSIASTGYTIISGKHFYFNTDGIM

FIG. 1 (continued)

QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 769)

>TcdA010
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG

FIG. 1 (continued)

WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 770)

>TcdA011
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGNKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKGIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG

FIG. 1 (continued)

WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 771)

>TcdA012
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDVNTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYNNDGVMQLGVFKGPDGFEYFAPANTQNNNIEGQAI
VYQSKFLTLNGKKYYFDNNSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK

FIG. 1 (continued)

KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTDANNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 772)

>TcdA013
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFVNYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNEVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDTSVSPDTKFILNNLKLNIESSVGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDLLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKEYGPLKT
EDDKILVPIDDLVISEIDFNNNAIKLGTCNILAMEGGSGHTVTGNIDHFFSSPSISSHIP
SLSIYSAIGIKTENLDFSKKIMMLPNAPSRVFWWETGAVPGLRSLENNGTKLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQAKVNGLYLNES
VYSSYLDFVKNADGHHNTSNFMNLFLDNISFWKLFGFENINFVVDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLVYIMSNFKSF
NSENELDRDHLGFKIIDNKTYYYDEASKLVKGLININNSLFYFDPIESNLVTGWQTINGK
KYYFDINTGAALTSYKIINGKHFYFNNNGVMQLGVFKGPDRFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEVATGWQTIDGKKYYFNTNTSIASTGYTIINGKHFYFNTDGIMQ
IGVFKGPDGFEYFAPANTDANNIEGQAILYQNKFLTLNGKKYYFASDSKAVTGWRIINNK

FIG. 1 (continued)

KYYFNPNNAIAATHLYTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAVAVTGWQTIDGKKYYFNTNTAEAATGWQTIDGKKYYFNTNTSIASTGYTIINGKHFY
FNTDGIMQIGVFKGPDGFEYFAPANTDANNIEGQAILYQNKFLTLNGKKYYFASDSKAVT
GLRTIDGKKYYFNTNTAEAATGWQTIDGKKYYFNTNTSIASTGYTIINDKHFYFNTDGIM
QIGVFKGPDGFEYFAPANTDANNIEGQAIRYQNRFLYLHDNIYYFGNNSKAATGWVTIDG
RRYYFEPNTAIGANGYKIIDNKNFYFRNGLPQIGVFKGPNGFEYFAPANTDANNIDGQAI
RYQNRFLHLLGNIYYFGNNSKAVTGWQTINGNMYYFMPDTAMAAAGGLFEIDGVIYFFGV
DGVKAPGIYG* (SEQ ID NO: 773)

>TcdA014
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENNGTKLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK

FIG. 1 (continued)

KYYFDINTGAALTSYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDDNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTYNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 774)

>TcdA015
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST

FIG. 1 (continued)

LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIIINGKHFYFNNDGVMQLGVFKGPDGFEYFAPANTQNNNIEGQAI
VYQSKFLTLNGKKYYFDNNSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 775)

>TcdA016
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNTKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT

FIG. 1 (continued)

EDDKILVPIDDLVISEIDFNNNSIKLGTCNILAMEGGSGHTVTGNIDHFFSSPYISSHIP
SLSVYSAIGIKTENLDFSKKIMMLPNAPSRVFWWETGAVPGLRSLENDGTKLLDSIRDLY
PGKFYWRFYAFFDYAITTLKPVYEDTNTKIKLDKDTRNFIMPTITTDEIRNKLSYSFDGA
GGTYSLLLSSYPISMNINLSKDDLWIFNIDNEVREISIENGTIKKGNLIEDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLNNISFWKLFGFENINFVIDKYFTLVGKTNLGYVE
FICDNNKNIDIYFGEWKTLSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIESNLVTGWQTINGK
KYYFDINTGAASTSYKIINGKHFYFNNNGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTSIASTGYTIINGKHFYFNTDGIMQ
IGVFKGPNGFEYFAPANTDANNIEGQAILYQNKFLTLNGKKYYFGSDSKAITGWQTIDGK
KYYFNPNNAIAATHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDSKKYYFNL
NTAVAVTGWQTIDGEKYYFNLNTAEAATGWQTIDGKRYYFNTNTYIASTGYTIINGKHFY
FNTDGIMQIGVFKGPDGFEYFAPANTHNNNIEGQAILYQNKFLTLNGKKYYFGSDSKAVT
GLRTIDGKKYYFNTNTAVAVTGWQTINGKKYYFNTNTYIASTGYTIISGKHFYFNTDGIM
QIGVFKGPDGFEYFAPANTDANNIEGQAIRYQNRFLYLHDNIYYFGNDSKAATGWATIDG
NRYYFEPNTAMGANGYKTIDNKNFYFRNGLPQIGVFKGPNGFEYFAPANTDANNIDGQAI
RYQNRFLHLLGNIYYFGNNSKAVTGWQTINGKVYYFMPDTAMAAAGGLFEIDGVIYFFGV
DGVKAPGIYG* (SEQ ID NO: 776)

>TcdA017
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI

FIG. 1 (continued)

FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYENTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDDNSKAVTGWQTIDSKKYYFNTNTAEAATG
WQTIDGKKYYFNTNTAEAATGWQTIDGKKYYFNTNTSIASTGYTSINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 777)

>TcdA018
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD

FIG. 1 (continued)

NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDDNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTYNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 778)

\>TcdA019
MSLISKEELIKLAYSIRPRENEYKTILTNLDEYNKLTTNNNENKYLQLKKLNESIDVFMN

FIG. 1 (continued)

KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNEVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKEYGPLKT
EDDKILVPIDDLVISEIDFNNNAIKLGTCNILAMEGGSGHTVTGNIDHFFSSPSISSHIP
SLSIYSAIGIKTENLDFSKKIMMLPNAPSRVFWWETGAVPGLRSLENNGTKLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVVDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLVYIMSNFKSF
NSENELDRDHLGFKIIDNKTYYYDEASKLVKGLININNSLFYFDPIESNLVTGWQTINGK
KYYFDINTGAASTSYKIINGKHFYFNNNGVMQLGVFKGPDGFEYFAPANTQNNNIEGQAI
VYQSKFLTLNGKKYYFDNNSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTSIASTGYTIINGKHFYFNTDGIMQ
IGVFKGPNGFEYFAPANTHNNNIEGQAILYQNKFLTLNGKKYYFGSDSKAITGWQTIDGK
KYYFNPNNAIAATHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAVAVTGWQTIDGKKYYFNLNTAEAATGWQTIDGKKYYFNTNTFIASTGYTIINGKHFY
FNTDGIMQIGVFKGTNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGSDGFEYFAPANTDANNIEGQAIRYQNRFLYLHDNIYYFGNNSKAVTGWATIDG
NRYYFEPDTAMGTNGYKTIDNKNFYFRNGLPQIGVFKGPNGFEYFAPANTDANNIDGQAI

FIG. 1 (continued)

RYQNRFLHLLGNIYYFGNNSKAVTGWQTINGKVYYFMPDTAMAAAGGLFEIDGVIYFFGV
DGVKAPGIYG* (SEQ ID NO: 779)

>TcdA020
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
PRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKDSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPYISSHIP
SLSVYSAIGIKTENLDFSKKIMMLPNAPSRVFWWETGAVPGLRSLENDGTKLLDSIRDLY
PGKFYWRFYAFFDYAITTLKPVYEDTNIKIKLDKDTRNFIMPTITTDEIRNKLSYSFDGA
GGTYSLLLSSYPISMNINLSKDDLWIFNIDNEVREISIENGTIKKGNLIEDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLNNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLLYFDPIESNLVTGWQTINGK
KYYFDINTGAASTSYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNLTAEAATGWQTIDGKKYYFNTNTSIASTGYTIINGKYFYFNTDGIMQ
IGVFKGPNGFEYFAPANTHNNNIEGQAILYQNKFLTLNGKKYYFGSDSKAITGWQTIDGK
KYYFNPNNAIAATHLYTINNDKYYFSYDGILQNGYITIERNNFYFDANNESKMVTGVFKG

FIG. 1 (continued)

PNGFEYFAPANTHNNNIEGQAIVYQNKFLTLNGKKYYFDNDSKAVTGWQTIDSKKYYFNL
NTAVAVTGWQTIDGEKYYFNLNTAEAATGWQTIDGKRYYFNTNTYIASTGYTIINGKHFY
FNTDGIMQIGVFKGPDGFEYFAPANTDANNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNDSKAATGWATIDG
NRYYFEPNTAMGANGYKTIDNKNFYFRNGLPQIGVFKGPNGFEYFAPANTDANNIDGQAI
RYQNRFLHLLGKIYYFGNNSKAVTGWQTINSKVYYFMPDTAMAAAGGLFEIDGVIYFFGV
DGVKAPGIYG* (SEQ ID NO: 780)

>TcdA021
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNVKLWYDSEAFLVNTLKKAIVESSTTEALQLLEEEIQNPQFDNTKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
PRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPYISSHIP
SLSVYSAIGIKTENLDFSKKIMMLPNAPSRVFWWETGAVPGLRSLENDGTKLLDSIRDLY
PGKFYWRFYAFFDYAITTLKPVYEDTNTKIKLDKDTRNFIMPTITTDEIRNKLSYSFDGA
GGTYSLLLSSYPISMNINLSKDDLWIFNIDNEVREISIENGTIKKGNLIEDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLNNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIYFKDIKKLSLGYIMSNFKSF
NSENELDRDHLGFKIIDNKTYYYDEDSKLVKGLININNSLFYFDPIESNLVTGWQTINGK
KYYFDINTGAASTSYKIINGKHFYFNNNGVMQLGVFKGPDGFEYFAPANTQNNNIEGQAI

FIG. 1 (continued)

VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTSIASTGYTIINGKHFYFNTDGIMQ
IGVFKGPNGFEYFAPANTHNNNIEGQAILYQNKFLTLNGKKYYFGSDSKAITGWQTIDGK
KYYFNPNNAIAATHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDSKKYYFNL
NTAVAVTGWQTIDGEKYYFNLNTAEAATGWQTIDGKRYYFNTNTYIASTGYTIINGKHFY
FNTDGIMQIGVFKGPDGFEYFAPANTHNNNIEGQAILYQNKFLTLNGKKYYFGSDSKAVT
GLRTIDGKKYYFNTNTAVAVTGWQTINGKKYYFNTNTYIASTGYTIISGKHFYFNTDGIM
QIGVFKGPDGFEYFAPANTDANNIEGQAIRYQNRFLYLHDNIYYFGNDSKAATGWATIDG
NRYYFEPNTAMGANGYKTIDNKNFYFRNGLPQIGVFKGPNGFEYFAPANTDANNIDGQAI
RYQNRFLHLLGNIYYFGNNSKAVTGWQTINGKVYYFMPDTAMAAAGGLFEIDGVIYFFGV
DGVKAPGIYG* (SEQ ID NO: 781)

>TcdA022
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKGIDFSISLVSKNQVKVNGLYLNES

FIG. 1 (continued)

VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAASTSYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDDNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 782)

>TcdA023
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
PRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYVQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKEYGPLKT
EDDKILVPIDDLVISEIDFNNNSIKLGTCNILAMEGGSGHTVTGNIDHFFSSPYISSHIP

FIG. 1 (continued)

SLSVYSAIGIKTENLDFSKKIMMLPNAPSRVFWWETGAVPGLRSLENNGTKLLDSIRDLY
PGKFYWRFYAFFDYAITTLKPVYEDTNTKIKLDKDTRNFIMPTITTDEIRNKLSYSFDGA
GGTYSLLLSSYPISMNINLSKDDLWIFNIDNEVREISIENGTIKKGNLIEDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLNNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIESNLVTGWQTINGK
KYYFDINTGAASTSYKIINGKHFYFNNNGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTSIASTGYTIINGKYFYFNTDGIMQ
IGVFKVPNGFEYFAPANTHNNNIEGQAILYQNKFLTLNGKKYYFGSDSKAITGWQTIDGK
KYYFNPNNAIAATHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDSKKYYFNL
NTAVAVTGWQTIDGEKYYFNLNTAEAATGWQTIDGKRYYFNTNTYIASTGYTIINGKHFY
FNTDGIMQIGVFKGPDGFEYFAPANTHNNNIEGQAILYQNKFLTLNGKKYYFGSDSKAVT
GLRTIDGKKYYFNTNTAVAVTGWQTINGKKYYFNTNTYIASTGYTIISGKHFYFNTDGIM
QIGVFKGPDGFEYFAPANTDANNIEGQAIRYQNRFLYLHDNIYYFGNDSKAATGWATIDG
NRYYFEPNTAMGANGYKTIDNKNFYFRNGLPQIGVFKGPNGFEYFAPANTDANNIDGQAI
RYQNRFLHLLGKIYYFGNNSKAVTGWQTINSKVYYFMPDTAMAAAGGLFEIDGVIYFFGV
DGVKAPGIYG* (SEQ ID NO: 783)

>TcdA024
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY

FIG. 1 (continued)

EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTSINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 784)

>TcdA025
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF

FIG. 1 (continued)

INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNRLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYFNNDGVMQLGVFKGPDGFEYFAPANTQNNNIEGQAI
VYQSKFLTLNGKKYYFDNNSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTDANNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 785)

>TcdA026
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI

FIG. 1 (continued)

NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
PRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPYISSHIP
SLSVYSAIGIKTENLDFSKKIMMLPNAPSRVFWWETGAVPGLRSLENDGTKLLDSIRDLY
PGKFYWRFYAFFDYAITTLKPVYEDTNTKIKLDKDTRNFIMPTITTDEIRNKLSYSFDGA
GGTYSLLLSSYPISMNINLSKDDLWIFNIDNEVREISIENGTIKKGNLIEDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLNNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIESNLVTGWQTINGK
KYYFDINTGAASTSYKIINGKHFYFNNNGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTSIASTGYTIINGKHFYFNTDGIMQ
IGVFKGPNGFEYFAPANTHNNNIEGQAILYQNKFLTLNGKKYYFGSDSKAITGWQTIDGK
KYYFNPNNAIAATHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDSKKYYFNL
NTAVAVTGWQTIDGEKYYFNLTAEAATGWQTIDGKRYYFNTNTYIASTGYTIINGKHFY
FNTDGIMQIGVFKGPDGFEYFAPANTHNNNIEGQAILYQNKFLTLNGKKYYFGSDSKAVT
GLRTIDGKKYYFNTNTAVAVTGWQTINGKKYYFNTNTYIASTGYTIISGKHFYFNTDGIM
QIGVFKGPDGFEYFAPANTDANNIEGQAIRYQNRFLYLHDNIYYFGNDSKAATGWATIDG
NRYYFEPNTAMGANGYKTIDNKNFYFRNGLPQIGVFKGPNGFEYFAPANTDANNIDGQAI
RYQNRFLHLLGKIYYFGNNSKAVTGWQTINSKVYYFMPDTAMAAAGGLFEIDGVIYFFGV

FIG. 1 (continued)

DGVKAPGIYG* (SEQ ID NO: 786)

>TcdA027
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
PRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKEYGPLKT
EDDKILVPIDDLVISEIDFNNNSIKLGTCNILAMEGGSGHTVTGNIDHFFSSPYISSHIP
SLSVYSAIGIKTENLDFSKKIMMLPNAPSRVFWWETGAVPGLRSLENNGTKLLDSIRDLY
PGKFYWRFYAFFDYAITTLKPVYEDTNTKIKLDKDTRNFIMPTITTDEIRNKLSYSFDGA
GGTYSLLLSSYPISMNINLSKDDLWIFNIDNEVREISIENGTIKKGNLIEDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLNNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLLYFDPIESNLVTGWQTINGK
KYYFDINTGAASTSYKIINGKHFYFNNDGVMQLGVFKGPDGFEYFAPANTHNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTSIASTGYTIINGKYFYFNTDGIMQ
IGVFKVPNGFEYFAPANTHNNNIEGQAILYQNKFLTLNGKKYYFGSDSKAITGWQTIDGK
KYYFNPNNAIAATHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDSKKYYFNL

FIG. 1 (continued)

NTAVAVTGWQTIDGEKYYFNLNTAEAATGWQTIDGKRYYFNTNTYIASTGYTIINGKHFY
FNTDGIMQIGVFKGPDGFEYFAPANTHNNNIEGQAILYQNKFLTLNGKKYYFGSDSKAVT
GLRTIDGKKYYFNTNTAVAVTGWQTINGKKYYFNTNTYIASTGYTIISGKHFYFNTDGIM
QIGVFKGPDGFEYFAPANTDANNIEGQAIRYQNRFLYLHDNIYYFGNDSKAATGWATIDG
NRYYFEPNTAMGANGYKTIDNKNFYFRNGLPQIGVFKGPNGFEYFAPANTDANNIDGQAI
RYQNRFLHLLGNIYYFGNNSKAVTGWQTINGKVYYFMPDTAMAAAGGLFEIDGAIYFFGV
DGVKAPGIYG* (SEQ ID NO: 787)

>TcdA028
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNVKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPYISSHIP
SLSVYSAIGIKTENLDFSKKIMMLPNAPSRVFWWETGAVPGLRSLENDGTKLLDSIRDLY
PGKFYWRFYAFFDYAITTLKPVYEDTNIKIKLDKDTRNFIMPTITTDEIRNKLSYSFDGA
GGTYSLLLSSYPISMNINLSKDDLWIFNIDNEVREISIENGTIKKGNLIEDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLNNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLLYFDPIESNLVTGWQTINGK
KYYFDINTGAASTSYKIINGKHFYFNNDGVMQLGVFKGPDGFEYFAPANTHNNNIEGQAI
VYQSKFLTLNGKKYYFDNDSKAVTGWRIINNEKYYFNPNNAIAAVGLQVIDNNKYYFNPD

FIG. 1 (continued)

TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTSIASTGYTIINGKYFYFNTDGIMQ
IGVFKVPNGFEYFAPANTHNNNIEGQAILYQNKFLTLNGKKYYFGSDSKAITGWQTIDGK
KYYFNPNNAIAATHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDSKKYYFNL
NTAVAVTGWQTIDGEKYYFNLNTAEAATGWQTIDGKRYYFNTNTYIASTGYTIINGKHFY
FNTDGIMQIGVFKGPDGFEYFAPANTHNNNIEGQAILYQNKFLTLNGKKYYFGSDSKAVT
GLRTIDGKKYYFNTNTAVAVTGWQTINGKKYYFNTNTYIASTGYTIISGKHFYFNTDGIM
QIGVFKGPDGFEYFAPANTDANNIEGQAIRYQNRFLYLHDNIYYFGNDSKAATGWATIDG
NRYYFEPNTAMGANGYKTIDNKNFYFRNGLPQIGVFKGPNGFEYFAPANTDANNIDGQAI
RYQNRFLHLLGNIYYFGNNSKAVTGWQTINGKVYYFMPDTAMAAAGGLFEIDGAIYFFGV
DGVKAPGIYG* (SEQ ID NO: 788)

\>TcdA029
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNTKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
PRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPYISSHIP
SLSVYSAIGIKTENLDFSKKIMMLPNAPSRVFWWETGAVPGLRSLENDGTKLLDSIRDLY
PGKFYWRFYAFFDYAITTLKPVYEDTNTKIKLDKDTRNFIMPTITTDEIRNKLSYSFDGA
GGTYSLLLSSYPISMNINLSKDDLWIFNIDNEVREISIENGTIKKGNLIEDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLNNISFWKLFGFENINFVIDKYFTLVGKTNLGYVE

FIG. 1 (continued)

FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIESNLVTGWQTINGK
KYYFDINTGAASTSYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTSIASTGYTIINGKHFYFNTDGIMQ
IGVFKGPNGFEYFAPANTHNNNIEGQAILYQNKFLTLNGKKYYFGSDSKAITGWQTIDGK
KYYFNPNNAIAATHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDSKKYYFNL
NTAVAVTGWQTIDGEKYYFNLNTAEAATGWQTIDGKRYYFNTNTYIASTGYTIINGKHFY
FNTDGIMQIGVFKGPDGFEYFAPANTHNNNIEGQAILYQNKFLTLNGKKYYFGSDSKAVT
GLRTIDGKKYYFNTNTAVAVTGWQTINGKKYYFNTNTYIASTGYTIISGKHFYFNTDGIM
QIGVFKGPDGFEYFAPANTDANNIEGQAIRYQNRFLYLHDNIYYFGNDSKAATGWATIDG
NRYYFEPNTAMGANGYKTIDNKNFYFRNGLPQIGVFKGPNGFEYFAPANTDANNIDGQAI
RYQNRFLHLLGNIYYFGNNSKAVTGWQTINGKVYYFMPDTAMAAAGGLFEIDGVIYFFGV
DGVKAPGIYG* (SEQ ID NO: 789)

>TcdA039
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY

FIG. 1 (continued)

PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDDNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTYNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTDANNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 790)

>TcdA040
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALYKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV

FIG. 1 (continued)

RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGSVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYNNDGVMQLGVFKGPDGFEYFAPANTQNNNIEGQAI
VYQSKFLTLNGKKYYFDNNSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEVATGWQTIDGKKYYFNLNTAEAATGWQTIDGKKYYFNTNTFIASTGYTSINGKHFY
FNTDGIMQIGVFKGPNGFEYFAPANTDANNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 791)

>TcdA041
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANGLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG

FIG. 1 (continued)

SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYFNNDGVMQLGVFKGPDGFEYFAPANTQNNNIEGQAI
VYQSKFLTLNGKKYYFDNNSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTDANNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 792)

>TcdA042
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD

FIG. 1 (continued)

RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGNKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKGIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDDNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 793)

FIG. 1 (continued)

>TcdA043
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTIINGKHFY

FIG. 1 (continued)

FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 794)

>TcdA044
MSLISKEELIKLAYSIRPRENEYKTILTNLDEYNKLTTNNNENKYLQLKKLNESIDVFMN
KYKTSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETVLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPKNNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKNSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGTRLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIEFNLVTGWQTINGK
KYYFDINTGAALTSYKIINGKHFYFNNDGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFA

FIG. 1 (continued)

PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTAIASTGYTIINGKHFYFNTDGIMQ
IGVFKGPNGFEYFAPANTDANNIEGQAILYQNEFLTLNGKKYYFGSDSKAVTGWRIINNK
KYYFNPNNAIAAIHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAEAATGWQTIDGKKYYFNLNTAEAATGWQTIDGKKYYFNTNTFIASTGYTSINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGPDGFEYFAPANTDANNIEGQAIRYQNRFLYLHDNIYYFGNNSKAATGWVTIDG
NRYYFEPNTAMGANGYKTIDNKNFYFRNGLPQIGVFKGSNGFEYFAPANTDANNIEGQAI
RYQNRFLHLLGKIYYFGNNSKAVTGWQTINGKVYYFMPDTAMAAAGGLFEIDGVIYFFGV
DGVKAPGIYG* (SEQ ID NO: 795)

>TcdA045
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNEVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKEYGPLKT
EDDKILVPIDDLVISEIDFNNNAIKLGTCNILAMEGGSGHTVTGNIDHFFSSPSISSHIP
SLSIYSAIGIKTENLDFSKKIMMLPNAPSRVFWWETGAVPGLRSLENNGTKLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVVDKYFTLVGKTNLGYVE
FICDNNKNIDIYFGEWKTSSSKSTIFSGNGRNVVVEPIYNPDTGEDISTSLDFSYEPLYG

FIG. 1 (continued)

IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLVYIMSNFKSF
NSENELDRDHLGFKIIDNKTYYYDEASKLVKGLININNSLFYFDPIESNLVTGWQTINGK
KYYFDINTGAASTSYKIINGKHFYFNNNGVMQLGVFKGPDGFEYFAPANTQNNNIEGQAI
VYQSKFLTLNGKKYYFDNNSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTSIASTGYTIINGKHFYFNTDGIMQ
IGVFKGPNGFEYFAPANTHNNNIEGQAILYQNKFLTLNGKKYYFGSDSKAITGWQTIDGK
KYYFNPNNAIAATHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAVAVTGWQTIDGKKYYFNLNTAEAATGWQTIDGKKYYFNTNTFIASTGYTIINGKHFY
FNTDGIMQIGVFKGTNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGSDGFEYFAPANTDANNIEGQAIRYQNRFLYLHDNIYYFGNNSKAVTGWATIDG
NRYYFEPDTAMGANGYKTIDNKNFYFRNGLPQIGVFKGPNGFEYFAPANTDANNIDGQAI
RYQNRFLHLLGNIYYFGNNSKAVTGWQTINGKVYYFMPDTAMAAAGGLFEIDGVIYFFGV
DGVKAPGIYG* (SEQ ID NO: 796)

>TcdA046
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANGLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNEVDFNKNTALDKNYLLNNKIPSNNIEEAGSKNYVHYIIQLQGGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKEYGPLKT
EDDKILVPIDDLVISEIDFNNNAIKLGTCNILAMEGGSGHTVTGNIDHFFSSPSISSHIP
SLSIYSAIGIKTENLDFSKKIMMLPNAPSRVFWWETGAVPGLRSLENNGTKLLDSIRDLY
PGKFYWRFYAFFDYAITTLKPVYEDTNIKIKLDKDTRNFIMPTITTNEIRNKLSYSFDGA

FIG. 1 (continued)

GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVVDKYFTLVGKTNLGYVE
FICDNNKNIDIYFGEWKTSSSKSTIFSGNGRNVVVEPIYNPDTGEDISTSLDFSYEPLYG
IDRYINKVLIALDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLVYIMSNFKSF
NSENELDRDHLGFKIIDNKTYYYDEASKLVKGLININNSLFYFDPIESNLVTGWQTINGK
KYYFDINTGAASTSYKIIINGKHFYFNNNGVMQLGVFKGPDGFEYFAPANTQNNNIEGQAI
VYQSKFLTLNGKKYYFDNNSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTSIASTGYTIINGKHFYFNTDGIMQ
IGVFKGPNGFEYFAPANTHNNNIEGQAILYQNKFLTLNGKKYYFGSDSKAITGWQTIDGK
KYYFNPNNAIAATHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAVAVTGWQTIDGKKYYFNLNTAEAATGWQTIDGKKYYFNTNTFIASTGYTIINGKHFY
FNTDGIMQIGVFKGPNGFEYFAPANTHNNNIEGQAILYQNKFLTLNGKKYYFGSDSKAVT
GLRTIDGKKYYFNTNTAVAVTGWQTINGKKYYFNTNTSIASTGYTIISGKHFYFNTDGIM
QIGVFKGSDGFEYFAPANTDANNIEGQAIRYQNRFLYLHDNIYYFGNNSKAVTGWATIDG
NRYYFEPDTAMGANGYKTIDNKNFYFRNGLPQIGVFKGPNGFEYFAPANTDANNIDGQAI
RYQNRFLHLLGNIYYFGNNSKAVTGWQTINGKVYYFMPDTAMAAAGGLFEIDGVIYFFGV
DGVKAPGIYG* (SEQ ID NO: 797)

>TcdA047
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
PRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTALDKNYLLNNKIPSNNVEEAGSKNYVHYIIQLQGDDISYEATCNLF
SKNPKNSIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT

FIG. 1 (continued)

LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKKYGPLKT
EDDKILVPIDDLVISEIDFNNNSIKLGTCNILAMEGGSGHTVTGNIDHFFSSPYISSHIP
SLSVYSAIGIKTENLDFSKKIMMLPNAPSRVFWWETGAVPGLRSLENDGTKLLDSIRDLY
PGKFYWRFYAFFDYAITTLKPVYEDTNTKIKLDKDTRNFIMPTITTDEIRNKLSYSFDGA
GGTYSLLLSSYPISMNINLSKDDLWIFNIDNEVREISIENGTIKKGNLIEDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLNNISFWKLFGFENINFVIDKYFTLVGKTNLGYVE
FICDNNKNIDIYFGEWKTLSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIESNLVTGWQTINGK
KYYFDINTGAASTSYKIINGKHFYFNNNGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTSIASTGYTIINGKHFYFNTDGIMQ
IGVFKGPNGFEYFAPANIHNNNIEGQAILYQNKFLTLNGKKYYFGSDSKAITGWQTIDGK
KYYFNPNNAIAATHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDSKKYYFNL
NTAVAVTGWQTIDGEKYYFNLNTAEAATGWQTIDGKRYYFNTNTYIASTGYTIINGKHFY
FNTDGIMQIGVFKGPDGFEYFAPANTHNNNIEGQAILYQNKFLTLNGKKYYFGSDSKAVT
GLRTIDGKKYYFNTNTAVAVTGWQTINGKKYYFNTNTYIASTGYTIISGKHFYFNTDGIM
QIGVFKGPDGFEYFAPANTDANNIEGQAIRYQNRFLYLHDNIYYFGNDSKAATGWATIDG
NRYYFEPNTAMGANGYKTIDNKNFYFRNGLPQIGVFKGPNGFEYFAPANTDANNIDGQAI
RYQNRFLHLLGKIYYFGNNSKAVTGWQTINGKVYYFMPDTAMAAAGGLFEIDGVIYFFGV
DGVKAPGIYG* (SEQ ID NO: 798)

>TcdA048
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFINYYKSQINKPTVPTIDDIIKSHLVSEYNRDETLLESYRTNSLRKINSNHGIDIR
ANSLFTEQELLNIYSQELLNRGNLAAASDIVRLLALKNFGGVYLDVDMLPGIHSDLFKTI
PRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNGVDFNKNTAFDKNYLLNNKIPSNNVEEAGSKNYVHYIIQLQGDDISYEATCNLF

FIG. 1 (continued)

SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDASVSPDTKFILNNLKLNIESSIGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDVLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKEYGPLKT
EDDKILVPIDDLVISEIDFNNNSIKLGTCNILAMEGGSGHTVTGNIDHFFSSPYISSHIP
SLSVYSAIGIKTENLDFSKKIMMLPNAPSRVFWWETGAVPGLRSLENNGTKLLDSIRDLY
PGKFYWRFYAFFDYAITTLKPVYEDTNTKIKLDKDTRNFIMPTITTDEIRNKLSYSFDGA
GGTYSLLLSSYPISMNINLSKDDLWIFNIDNEVREISIENGTIKKGNLIEDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQVKVNGLYLNES
VYSSYLDFVKNSDGHHNTSNFMNLFLNNISFWKLFGFENINFVIDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSF
NSENELDRDHLGFKIIDNKTYYYDEDSKLVKGLININNSLFYFDPIESNLVTGWQTINGK
KYYFDINTGAASTSYKIINGKHFYFNNNGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEAATGWQTIDGKKYYFNTNTSIASTGYTIINGKYFYFNTDGIMQ
IGVFKVPNGFEYFAPANTHNNNIEGQAILYQNKFLTLNGKKYYFGSDSKAITGWQTIDGK
KYYFNPNNAIAATHLCTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDSKKYYFNL
NTAVAVTGWQTIDGEKYYFNLNTAEAATGWQTIDGKRYYFNTNTYIASTGYTIINGKHFY
FNTDGIMQIGVFKGPDGFEYFAPANTHNNNIEGQAILYQNKFLTLNGKKYYFGSDSKAVT
GLRTIDGKKYYFNTNTAVAVTGWQTINGKKYYFNTNTYIASTGYTIISGKHFYFNTDGIM
QIGVFKGPDGFEYFAPANTDANNIEGQAIRYQNRFLYLHDNIYYFGNDSKAATGWATIDG
NRYYFEPNTAMGANGYKTIDNKNFYFRNGLPQIGVFKGPNGFEYFAPANTDANNIDGQAI
RYQNRFLHLLGKIYYFGNNSKAVTGWQTINSKVYYFMPDTAMAAAGGLFEIDGVIYFFGV
DGVKAPGIYG* (SEQ ID NO: 799)

>TcdA037
MSLISKEELIKLAYSIRPRENEYKTILTNLDEYNKLTTNNNENKYLQLKKLNESIDVFMN
KYKNSSRNRALSNLKKDILKEVILIKNSNTSPVEKNLHFVWIGGEVSDIALEYIKQWADI
NAEYNIKLWYDSEAFLVNTLKKAIVESSTTEALQLLEEEIQNPQFDNMKFYKKRMEFIYD
RQKRFVNYYKSQINKPTVPTIDDIIKSHLVSEYNRDETLLESYRTNSLRKINSNHGIDIR

FIG. 1 (continued)

ANSLFTEQELLNIYSQELLNRGNLAAASDIVRLLALKNFGGVYLDVDMLPGIHSDLFKTI
SRPSSIGLDRWEMIKLEAIMKYKKYINNYTSENFDKLDQQLKDNFKLIIESKSEKSEIFS
KLENLNVSDLEIKIAFALGSVINQALISKQGSYLTNLVIEQVKNRYQFLNQHLNPAIESD
NNFTDTTKIFHDSLFNSATAENSMFLTKIAPYLQVGFMPEARSTISLSGPGAYASAYYDF
INLQENTIEKTLKASDLIEFKFPENNLSQLTEQEINSLWSFDQASAKYQFEKYVRDYTGG
SLSEDNEVDFNKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKVTFIGHGKDEF
NTSEFARLSVDSLSNEISSFLDTIKLDISPKNVEVNLLGCNMFSYDFNVEETYPGKLLLS
IMDKITSTLPDVNKDSITIGANQYEVRINSEGRKELLAHSGKWINKEEAIMSDLSSKEYI
FFDSIDNKLKAKSKNIPGLASISEDIKTLLLDTSVSPDTKFILNNLKLNIESSVGDYIYY
EKLEPVKNIIHNSIDDLIDEFNLLENVSDELYELKKLNNLDEKYLISFEDISKNNSTYSV
RFINKSNGESVYVETEKEIFSKYSEHITKEISTIKNSIITDVNGNLLDNIQLDHTSQVNT
LNAAFFIQSLIDYSSNKDLLNDLSTSVKVQLYAQLFSTGLNTIYDSIQLVNLISNAVNDT
INVLPTITEGIPIVSTILDGINLGAAIKELLDEHDPLLKKELEAKVGVLAINMSLSIAAT
VASIVGIGAEVTIFLLPIAGISAGIPSLVNNELILHDKATSVVNYFNHLSESKEYGPLKT
EDDKILVPIDDLVISEIDFNNNAIKLGTCNILAMEGGSGHTVTGNIDHFFSSPSISSHIP
SLSIYSAIGIKTENLDFSKKIMMLPNAPSRVFWWETGAVPGLRSLENNGTKLLDSIRDLY
PGKFYWRFYAFFDYAITTLKPVYEDTNIKIKLDKDTRNFIMPTITTNEIRNKLSYSFDGA
GGTYSLLLSSYPISTNINLSKDDLWIFNIDNEVREISIENGTIKKGKLIKDVLSKIDINK
NKLIIGNQTIDFSGDIDNKDRYIFLTCELDDKISLIIEINLVAKSYSLLLSGDKNYLISN
LSNTIEKINTLGLDSKNIAYNYTDESNNKYFGAISKTSQKSIIHYKKDSKNILEFYNGST
LEFNSKDFIAEDINVFMKDDINTITGKYYVDNNTDKSIDFSISLVSKNQAKVNGLYLNES
VYSSYLDFVKNADGHHNTSNFMNLFLDNISFWKLFGFENINFVVDKYFTLVGKTNLGYVE
FICDNNKNIDIYFGEWKTSSSKSTIFSGNGRNVVVEPIYNPDTGEDISTSLDFSYEPLYG
IDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLVYIMSNFKSF
NSENELDRDHLGFKIIDNKTYYYDEASKLVKGLININNSLFYFDPIESNLVTGWQTINGK
KYYFDINTGAALTSYKIINGKHFYFNNNGVMQLGVFKGPDGFEYFAPANTQNNNIEGQAI
VYQSKFLTLNGKKYYFDNDSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSGSNGFEYFA
PANTYNNNIEGQAIVYQSKFLTLNGKKYYFDNNSKAVTGWQTIDSKKYYFNTNTAEAATG
WQTIDGKKYYFNTNTAEVATGWQTIDGKKYYFNTNTSIASTGYTIINGKHFYFNTDGIMQ
IGVFKGPDGFEYFAPANTDANNIEGQAILYQNKFLTLNGKKYYFASDSKAVTGWRIINNK
KYYFNPNNAIAATHLYTINNDKYYFSYDGILQNGYITIERNNFYFDANNESKMVTGVFKG
PNGFEYFAPANTHNNNIEGQAIVYQNKFLTLNGKKYYFDNDSKAVTGWQTIDGKKYYFNL
NTAVAVTGWQTIDGKKYYFNTNTAEAATGWQTIDGKKYYFNTNTSIASTGYTIINGKHFY
FNTDGIMQIGVFKGPDGFEYFAPANTDANNIEGQAILYQNKFLTLNGKKYYFASDSKAVT
GLRTIDGKKYYFNTNTAEAATGWQTIDGKKYYFNTNTSIASTGYTIINDKHFYFNTDGIM
QIGVFKGPDGFEYFAPANTDANNIEGQAIRYQNRFLYLHDNIYYFGNNSKAATGWVTIDG
RRYYFEPNTAIGANGYKIIDNKNFYFRNGLPQIGVFKGPNGFEYFAPANTDANNIDGQAI
RYQNRFLHLLGNIYYFGNNSKAVTGWQTINGNMYYFMPDTAMAAAGGLFEIDGVIYFFGV
DGVKAPGIYG* (SEQ ID NO: 800)

FIG. 2

>TcdB001
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDYKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 801)

FIG. 2 (continued)

>TcdB002
MSLVNRKQLEKMANVRFRVQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTIVESATNDTLESFRENLNDPRFDYNKFYRKRMEIIY
DKQKNFINYYKTQREENPDLIIDDIVKIYLSNEYSKDIDELNSYIEESLNKVTENSGNDV
RNFEEFKGGESFKLYEQELVERWNLAAASDILRISALKEVGGVYLDVDMLPGIQPDLFES
IEKPSSVTVDFWEMVKLEAIMKYKEYIPGYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNAFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKKNYFE
GSLGEDDNLDFSQNTVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGLDVDSLSTEIETAIDLAKEDISPKSIEINLLGCNMFSYSVNVEETYPGKLLLRVK
DKVSELMPSISQDSIIVSANQYEVRINSEGRRELLDHSGEWINKEESIIKDISSKEYISF
NPKENKIIVKSKNLPELSTLLQEIRNNSNSSDIELEEKVMLAECEINVISNIDTQVVEGR
IEEAKSLTSDSINYIKNEFKLIESISDALYDLKQQNELEESHFISFEDILETDEGFSIRF
IDKETGESIFVETEKAIFSEYANHITEEISKIKGTIFDTVNGKLVKKVNLDATHEVNTLN
AAFFIQSLIEYNSSKESLSNLSVAMKVQVYAQLFSTGLNTITDAAKVVELVSTALDETID
LLPTLSEGLPVIATIIDGVSLGAAIKELSETSDPLLRQEIEAKIGIMAVNLTAATTAIIT
SSLGIASGFSILLVPLAGISAGIPSLVNNELILRDKATKVVDYFSHISLAESEGAFTSLD
DKIMMPQDDLVISEIDFNNNSITLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPVITTEYIREKLSYSFYGSG
GTYALSLSQYNMNINIELNENDTWVIDVDNVVRDVTIESDKIKKGDLIENILSKLSIEDN
KIILDNHEINFSGTLNGGNGFVSLTFSILEGINAVIEVDLLSKSYKVLISGELKTLMANS
NSVQQKIDYIGLNSELQKNIPYSFMDDKGKENGFINCSTKEGLFVSELSDVVLISKVYMD
NSKPLFGYCSNDLKDVKVITKDDVIILTGYYLKDDIKISLSFTIQDENTIKLNGVYLDEN
GVAEILKFMNKKGSTNTSDSLMSFLESMNIKSIFINSLQSNTKLILDTNFIISGTTSIGQ
FEFICDKDNNIQPYFIKFNTLETKYTLYVGNRQNMIVEPNYDLDDSGDISSTVINFSQKY
LYGIDSCVNKVIISPNIYTDEINITPIYEANNTYPEVIVLDTNYISEKININDLSIRY
VWSNDGSDFILMSTDEENKVSQVKIRFTNVFKGNTISDKISFNFSDKQDVSINKVISTFT
PSYYVEGLLNYDLGLISLYNEKFYINNFGMMVSGLVYINDSLYYFKPPIKNLITGFTTIG
DDKYYFNPDNGGAASVGETIIDGKNYYFSQNGVLQTGVFSTEDGFKYFAPADTLDENLEG
EAIDFTGKLTIDENVYYFGDNYRAAIEWQTLDDEVYYFSTDTGRAFKGLNQIGDDKFYFN
SDGIMQKGFVNINDKTFYFDDSGVMKSGYTEIDGKYFYFAENGEMQIGVFNTADGFKYFA
HHDEDLGNEEGEALSYSGILNFNNKIYYFDDSFTAVVGWKDLEDGSKYYFDEDTAEAYIG
ISIINDGKYYFNDSGIMQIGFVTINNEVFYFSDSGIVESGMQNIDDNYFYIDENGLVQIG
VFDTSDGYKYFAPANTVNDNIYGQAVEYSGLVRVGEDVYYFGETYTIETGWIYDMENESD
KYYFDPETKKAYKGINVIDDIKYYFDENGIMRTGLITFEDNHYYFNEDGIMQYGYLNIED
KTFYFSEDGIMQIGVFNTPDGFKYFAHQNTLDENFEGESINYTGWLDLDEKRYYFTDEYI
AATGSVIIDGEEYYFDPDTAQLVISE* (SEQ ID NO: 802)

FIG. 2 (continued)

>TcdB003
MSLVNRKQLEKMANVRFRVQEDEYVAILDALEEYHNMSENTVVEKYLKLKDINSLTDTYI
DTYKKSGRNKALKKFKEYLVIEILELKNSNLTPVEKNLHFIWIGGQINDTAINYINQWKD
VNSDYNVNVFYDSNAFLINTLKKTIIESASNDTLESFRENLNDPEFNHTAFFRKRMQIIY
DKQQNFINYYKAQKEENPDLIIDDIVKTYLSNEYSKDIDELNAYIEESLNKVTENSGNDV
RNFEEFKTGEVFNLYEQELVERWNLAGASDILRVAILKNIGGVYLDVDMLPGIHPDLFKD
INKPDSVKTAVDWEEMQLEAIMKHKEYIPEYTSKHFDTLDEEVQSSFESVLASKSDKSEI
FLPLGDIEVSPLEVKIAFAKGSIINQALISAKDSYCSDLLIKQIQNRYKILNDTLGPIIS
QGNDFNTTMNNFGESLGAIANEENISFIAKIGSYLRVGFYPEANTTITLSGPTIYAGAYK
DLLTFKEMSIDTSILSSELRNFEFPKVNISQATEQEKNSLWQFNEERAKIQFEEYKKNYF
EGALGEDDNLDFSQNTVTDKEYLLEKISSSTKSSERGYVHYIVQLQGDKISYEAACNLFA
KNPYDSILFQKNIEDSEVAYYYNPTDSEIQEIDKYRIPDRISDRPKIKLTFIGHGKAEFN
TDIFAGLDVDSLSSEIETAIGLAKEDISPKSIEINLLGCNMFSYSVNVEETYPGKLLLRV
KDKVSELMPSMSQDSIIVSANQYEVRINSEGRRELLDHSGEWINKEESIIKDISSKEYIS
FNPKENKIIVKSKNLPELSTLLQEIRNNSNSSDIELEEKVMLAECEINVISNIETQVVEE
RIEEAKSLTSDSINYIKNEFKLIESISDALCDLKQQNELEDSHFISFEDISETDEGFSIR
FINKETGESIFVETEKTIFSEYANHITEEISKIKGTIFDTVNGKLVKKVNLDTTHEVNTL
NAAFFIQSLIEYNSSKESLSNLSVAMKVQVYAQLFSTGLNTITDAAKVVELVSTALDETI
DLLPTLSEGLPIIATIIDGVSLGAAIKELSETSDPLLRQEIEAKIGIMAVNLTTATTAII
TSSLGIASGFSILLVPLAGISAGIPSLVNNELVLRDKATKVVDYFKHVSLVETEGVFTLL
DDKVMMPQDDLVISEIDFNNNSIVLGKCEIWRMEGGSGHTVTDDIDHFFSAPSITYREPH
LSIYDVLEVQKEELDLSKDLMVLPNAPNRVFAWETGWTPGLRSLENDGTKLLDRIRDNYE
GEFYWRYFAFIADALITTLKPRYEDTNIRINLDSNTRSFIVPIITTEYIREKLSYSFYGS
GGTYALSLSQYNMGINIELSESDVWIIDVDNVVRDVTIESDKIKKGDLIEGILSTLSIEE
NKIILNSHEINFSGEVNGSNGFVSLTFSILEGINAIIEVDLLSKSYKLLISGELKILMLN
SNHIQQKIDYIGFNSELQKNIPYSFVDSEGKENGFINGSTKEGLFVSELPDVVLISKVYM
DDSKPSFGYYSNNLKDVKVITKDNVNILTGYYLKDDIKISLSLTLQDEKTIKLNSVHLDE
SGVAEILKFMNRKGSTNTSDSLMSFLESMNIKSIFVNFLQSNIKFILDANFIISGTTSIG
QFEFICDENNNIQPYFIKFNTLETNYTLYVGNRQNMIVEPNYDLDDSGDISSTVINFSQK
YLYGIDSCVNKVVISPNIYTDEINITPVYETNNTYPEVIVLDANYINEKINVNINDLSIR
YVWSNDGNDFILMSTSEENKVSQVKIRFVNVFKDKTLANKLSFNFSDKQDVPVSEIILSF
TPSYYEDGLIGYDLGLVSLYNEKFYINNFGMMVSGLIYINDSLYYFKPPVNNLITGFVTV
GDDKYYFNPINGGAASIGETIIDDKNYYFNQSGVLQTGVFSTEDGFKYFAPANTLDENLE
GEAIDFTGKLIIDENIYYFEDNYRGAVEWKELDGEMHYFSPETGKAFKGLNQIGDDKYYF
NSDGVMQKGFVSINDNKHYFDDSGVMKVGYTEIDGKHFYFAENGEMQIGVFNTEDGFKYF
AHHNEDLGNEEGEEISYSGILNFNNKIYYFDDSFTAVVGWKDLEDGSKYYFDEDTAEAYI
GLSLINDGQYYFNDDGIMQVGFVTINDKVFYFSDSGIIESGVQNIDDNYFYIDDNGIVQI
GVFDTSDGYKYFAPANTVNDNIYGQAVEYSGLVRVGEDVYYFGETYTIETGWIYDMENES
DKYYFDPETKKACKGINLIDDIKYYFDEKGIMRTGLISFENNNYYFNENGEMQFGYINIE
DKMFYFGEDGVMQIGVFNTPDGFKYFAHQNTLDENFEGESINYTGWLDLDEKRYYFTDEY
IAATGSVIIDGEEYYFDPDTAQLVISE* (SEQ ID NO: 803)

FIG. 2 (continued)

>TcdB004

MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTIVESAINDTLESFRENLNNPRFDYNKFFRKRMEIIY
DKQKNFINYYKAQREENPELIIDDIVKIYLSNEYSKEIDELNTYIEESLNKIKQNSGNDV
RNFEEFKNGESFKLYEQELVERWNLAAASDILRISALKEIGGMYLDVDMLPGIQPDLFES
IEKPSSVTVDFWEMTKLEAIMKYKEYIPGYTSEHFDMLDEEVQSSFESALASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTVNLSGPEAYAAAYQD
LLMFKEGSMNIHLIEADLRNFEISKTNISQSTEQEMASLWTFDDARAKVQFEEYKRNYFE
GSLGEDDNLDFSQNIVVDKEYLLEKISSLARSSERGYIHYIVQLQGDKISYEAACNLFAK
TPYDSILFQKNIENSEVAYYYNPGDGEIQEIDKYRIPSIISDRPKIKLTFIGHGKDEFNT
DIFAGLDVDSLSTEIETAIDLAKEDISSKSIEINLLGCNMFSYSINVEETYPGKLLLKVK
DKISELMPSISQDSIIVSANQYEVRINNEGRRELLDHSGEWINKEESIIKDISSKEYISF
NPKENKITVKSKNLPELSTLLQEIRNNSNLSDIELEEKVMLAECEINVISNIDTQIVEER
IEEAKNLTSDSINYIKNEFKLIESISDSLYDLKQQNELDDSHFISFEDISKTEDGFSIRF
INKETGESIFVETEKEIFSEYANHIEREISNIKDTIFDTVNGKLVKKVNLDAIHEVNTLN
AAFFIQSLIGYSSSKESLSNLSVAMKVQVYAQLFSTGLNTITDAAKVVELVSTALDETID
LLPTLSEGLPVIATIIDGVSLGAAIKELSETSDPLLRQEIEAKIGIMAVNLTAATTAIIT
SSLGIASGFSILLVPLAGISAGIPSLVNNELVLRDKATKVVDYFKHISLVETEGAFTLLD
DKIMIPQDDLVISEIDFNNNSIVLGKCEIWRMEGGSGHTVTNDIDHFFSSPTITYIKPHL
SIYDVLEVQKEELDLSKDLMVLPNAPNRVFAWETGWTPGLRSLENEGTKLLDRIRDHYKG
EFYWRYFAFIADALITTLKPRYEDTNIRINLDSNNRSFIVPIITTEHIREKLSYSFHGSG
GTYALSLSQYNMGINIELSESDVWIIDVDNVVRDVTIDSDKIKKGDLIEGILSTLSIEDN
KIILNHHEINFSGDVNGSNGFISLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSFTLQDEKTIKLNGVHLDES
GVAEILKFMNKKGSTNTSDSLMSFLESVNIKSIFVNFLQSKINFILDANFIISGTTSIGQ
FEFICDENDNIQPYFIKFNTLETTYTLYVGNRQNMIVEPNYDLDDSGDISSTVINFSQKY
LYGIDSCVNKVVISPNIYTDEINITPVYETNNNYPEVIVLDANYINEKINVNINDLSIRY
VWSNDGNDFILMSTSEENKVSQVKIRFVNVFKDKTLANKLSFNFSDKQDVPVSEIISAFT
PSYYEDGLIGYDLGLVSLYNEKFYINNFGMMVSGLIYINDSLYYFKPPVNNLITGFVTVG
DDKYYFNPTNGGAASIGETIINDKNYYFNQSGILQTGVFSTEDGLKYFAPANTLDENLEG
EAIDFTGKLIIDENIYYFEDNYRGAVEWKELDGEMYYFSPETGKAFKGLNQIGDDKYYFN
SDGIMQKGFVSINDKKYYFDDSGVMKVGYIEIDGKYFYFAENGEMQIGVFNTSDGFKYFA
HHNEDLGNEEGEAISYSGILNFNNKIYYFDYSFTAVVGWKDLEDGSKYYFDEDTAEAYVG
LSLINDGQYYFNDDGIMQVGFVTINNKVFYFSDSGIIESGVQNIDDNYFYIDEKGIVQIG
VFDTSDEYKYFAPANTVNDNIYGQAVDYSGLVRVGEDIYYFGETYTIETGWIYDMENESD
KYYFNPETKKACKGINLIDDIKYYFDENGIMRTGLISFENNDYYFNENGEMQFGYINIED
KMFYFGEDGVMQIGVFNTQDGFKYFAHQNTLDENFEGESINYTGWLDLDEKRYYFTDEYI
AATGSVIIDGEEYYFDPDTAQLVISE* (SEQ ID NO: 804)

FIG. 2 (continued)

>TcdB005
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEIFKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTDYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDYKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 805)

FIG. 2 (continued)

>TcdB006
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTIVESATNDTLESFRENLNDPRFDYNKFFRKRMEIIY
DKQKNFINYYKAQREENPELIIDDIVKTYLSNEYSKEIDELNAYIEESLNKITQNSGNDV
RNFEEFKNGESFNLYEQELVERWNLAAASDILRISALKEIGGVYLDVDMLPGIQPDLFES
IEKPSSVTVDFWEMTKLEAIMKYKEYIPGYTSEHFDMLDEEVQSSFESALASKSDKSEIF
SSLGDMEASPLEVKIAFNSKGIINQGLISVKDSYCSNLIVKQIENRYKILNNSLNPAISE
DNDFNTTTNAFIDSIMAEANADNGRFMMELGKYLRVGFFPDVKTTINLSGPEAYAAAYQD
LLMFKEDSMNIHLIEADLRNFEIPKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSILFQKNIEDSEIAYYYNPGDGEIQEIDKYKIPSIISDRPKIKLTFIGHGKDEFNT
DIFAGLDVDSLSTEIETAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKNEFKLIESISDALCDLKQQNELDDSHFISFEDISETDEGFSIRF
INKETGESIFVETEKTIFSEYANHITEEISKIKDTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPVIATIIDGVSLGAAIKELSETSDPLLRQEIEAKIGIMAVNLTAATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTITDDIDHFFSAPSITYREPHL
SIYDVLEVQKEELDLSKDLMVLPNAPNRVFAWETGWTPGLRSLENDGTKLLDRIRDHYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGDVNGSNGFVSLTFSILEGINAIIEVDLLSKSYKLLISGELKILMLNS
NHIQQKIDYIGFNSELQKNIPYSFVNDEGKENGFINGSTKEGLFVSELPDVVLISKVYMD
DSKPSFGYYSNNLKDVKVITKDDVNILTGYYLKDDIKISLSLTLQDEKTIKLNSVHLDES
GVAEILKFMNKKGSTNTSDSLMSFLESMNIKSIFVNFLQSNIKFILDTNFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSKIISSFT
PSYYDGGLIGYGLGLVSLYNEKFYINNFGMMVSGLIYINDSLYYFKPPVNNLITGFMTVG
DDKYYFNPTNGGAASIGETIIDDKNYYFNQSGVLQTGVFSTEDGFKYFAPANTLDENLEG
EAIDFTGKLIIDENIYYFEDNYRGAVEWKELDGEMYYFSPETGKAFKGLNQIGDDKYYFN
SDGVMQKGFVSINDKKHYFDDSGVMKVGYTEIDGKYFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVAINDKVFYFSDSGIIESGVQNIDDNYFYIDEKGIVQIG
VFDTSDGYKYFAPANTVNDNIYGQAVEYSGLVRVGEDVYYFGETYTIETGWIYDMENESD
KYYFNPETKKACKGINLIDDIKYYFDENGIMRTGLISFENNDYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 806)

FIG. 2 (continued)

>TcdB007
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDSRAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDDKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 807)

FIG. 2 (continued)

>TcdB008
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDDKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 808)

FIG. 2 (continued)

>TcdB009
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMLSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDDKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 809)

FIG. 2 (continued)

>TcdB010
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPGLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDYKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 810)

FIG. 2 (continued)

>TcdB011
MSLVNRKQLEKMANVRFRVQEDEYVAILDALEEYHNMSENTVVEKYLKLKDINSLTDTYI
DTYKKSGRNKALKKFKEYLVTEILELKNSNLTPVEKNLHFIWIGGQINDTAINYINQWKD
VNSDYNVNVFYDSNAFLINTLKKTIIESASNDTLESFRENLNDPEFNHTAFFRKRMQIIY
DKQQNFINYYKAQKEENPDLIIDDIVKTYLSNEYSKDIDELNAYIEESLNKVTENSGNDV
RNFEEFKTGEVFNLYEQELVERWNLAGASDILRVAILKNIGGVYLDVDMLPGIHPDLFKD
INKPDSVKTAVDWEEMQLEAIMKYKEYIPEYTSKHFDTLDEEVQSSFESVLASKSDKSEI
FLPLGDIEVSPLEVKIAFAKGSIINQALISAKDSYCSDLLIKQIQNRYKILNDTLGPIIS
QGNDFNTTMNNFGESLGAIANEENISFIAKIGSYLRVGFYPEANTTITLSGPTIYAGAYK
DLLTFKEMSIDTSILSSELRNFEFPKVNISQATEQEKNSLWQFNEERAKIQFEEYKKNYF
EGALGEDDNLDFSQNTVIDKEYLLEKISSSTKSSERGYVHYIVQLQGDKISYEAACNLFA
KNPYDSILFQKNIEDSEVAYYYNPTDSEIQEIDKYRIPDRISDRPKIKLTLIGHGKAEFN
TDIFAGLDVDSLSSEIETIIDLAKADISPKSIEINLLGCNMFSYSVNVEETYPGKLLLRV
KDKVSELMPSISQDSIIVSANQYEVRINSEGRRELLDHSGEWINKEESIIKDISSKEYIS
FNPKENKIIVKSKNLPELSTLLQEIRNNSNSSDIELEEKVMLAECEINVISNIETQVVEE
RIEEAKSLTSDSINYIKNEFKLIESISDALYDLKQQNELEESHFISFEDISETDEGFSIR
FIDKETGESIFVETEKAIFSEYANHITEEISKIKGTIFDTVNGKLVKKVNLDATHEVNTL
NAAFFIQSLIEYNSSKESLSNLSVAMKVQVYAQLFSTGLNTITDAAKVVELVSTALDETI
DLLPTLSEGLPVIATIIDGVSLGAAIKELSETSDPLLRQEIEAKIGIMAVNLTAATTAII
TSSLGIASGFSILLVPLAGISAGIPSLVNNELILRDKATKVVDYFSHISLAESEGAFTSL
DDKIMMPQDDLVISEIDFNNNSITLGKCEIWRMEGGSGHTVTDDIDHFFSSPSITYREPH
LSIYDVLEVKKEELDLSKDLMVLPNAPNRVFGWETGWTPGLRGLENDGTKLLDRIRDQYE
GQFYWRFFAFIADALITTLKPRYEDTNVRISLDSNTRSFIVPVITTEYIREKLSYSFYGS
GGTYALSLSQYNMNINIELNENDTWVIDVDNVVRSVTIESDKIKKGDLIENILSKLSIED
NKIILDNHEINFSGTLNGGNGFVSLTFSILEGINAVIEVDLLSKSYKVLISGELKTLMAN
SNSVQQKIDYIGLNSELQKNIPYSFMDDKGKENGFINCSTKEGLFVSELSDVVLIIKVYM
DNSKPPFGYYSNDLKDVKAITKDDVIILTGYYLKDDIKISLSFTIQDKNTIKLNGVYLDE
NGVAEILKFMNKKGSTNTSDSLMSFLESMNIKSIFIKSLKSNAKLILDTNFIISGTTSIG
QFEFICDKDNNIQPYFIKFNTLETKYTLYVGNRQNMIVEPNYDLDDSGDISSTVINFSQK
YLYGIDSCVNKVIISPNIYTDEINITPIYEANNTYPEVIVLDTNYISEKININDLSIR
YVWSNDGSDFILMSTDEENKVSQVKIRFTNVFKGNTISDKISFNFSDKQDVSINKIISTF
TPSYYVEGLLNYHLGLISLYNEKFYINNFGMMVSGLVYINDSLYYFKPPIKNLITGFTTI
GDDKYYFNPDNGGAASVGETIIDGKNYYFSPNGVLQTGVFSTEDGFKYFAPADTLDENLE
GEAIDFTGKLIIDENVYYFGDNYRAAIEWQTLDDEVYYFSTDTGRAFKGLNQIGDDKFYF
NSDGIMQKGFVNINDKTFYFDDSGVMKSGYTEIDGKHFYFAENGEMQIGVFNTADGFKYF
AHHDEDLGNEEGEALSYSGILNFNNKIYYFDDSFTAVVGWKDSEDGSKYYFDEDTAEAYI
GISTINDGKYYFNDSGIMQIGFVTINNEVFYFSDSGIVESGMQNIDDNYFYIDENGLVQI
GVFDTSDGYKYFAPANTVNDNIYGQAVEYSGLVRVGEDVYYFGETYTIETGWIYDMENES
DKYYFDPETKKAYKGINVIDDIKYYFDENGIMRTGLITFEDNHYYFNEDGIMQYGYINIE
DKMFYFNEDGVMQIGVFNTADGFKYFAHQNTLDENFEGESINYTGWLDLDEKRYYFTDEY
IAAIGSVIIDGEEYYFDPDTAELVISE* (SEQ ID NO: 811)

FIG. 2 (continued)

>TcdB012
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGVASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDYKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 812)

FIG. 2 (continued)

>TcdB013
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGSTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDDKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 813)

FIG. 2 (continued)

\>TcdB014
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYRFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDDKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 814)

FIG. 2 (continued)

>TcdB015
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETEEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFEDNYRGAVEWKELDGEMHYFSPETGKAFKGLNQIGDDKYYFN
SDGVMQKGFVSINDNKHYFDDSGVMKVGYTEIDGKYFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 815)

FIG. 2 (continued)

>TcdB016
MSLVNRKQLEKMANVRFRTQEDEYVAILDALEEYHNMSENTVVEKYLKLKDINSLTDIYI
DTYKKSGRNKALKKFKEYLVIEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGSTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDDKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 816)

FIG. 2 (continued)

>TcdB018
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETEEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDDKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 817)

FIG. 2 (continued)

>TcdB019
MSLVNRKQLEKMANVRFRVQEDEYVAILDALEEYHNMSENTVVEKYLKLKDINSLTDTYI
DTYKKSGRNKALKKFKEYLVTEILELKNSNLTPVEKNLHFIWIGGQINDTAINYINQWKD
VNSDYNVNVFYDSNAFLINTLKKTIIESASNDTLESFRENLNDPEFNHTAFFRKRMQIIY
DKQQNFINYYKVQKEENPDLIIDDIVKTYLSNEYSKDIDELNAYIEESLNKVTENSGNDV
RNFEEFKTGEVFNLYEQELVERWNLAGASDILRVAILKNIGGVYLDVDMLPGIHPDLFKD
INKPDSVKTAVDWEEMQLEAIMKYKEYIPEYTSKHFDTLDEEVQSSFESVLASKSDKSEI
FLPLGDIEVSPLEVKIAFAKGSIINQALISAKDSYCSDLLIKQIQNRYKILNDTLGPIIS
QGNDFNTTMNNFGESLGAIANEENISFIAKIGSYLRVGFYPEANTTITLSGPTIYAGAYK
DLLTFKEMSIDTSILSSELRNFEFPKVNISQATEQEKNSLWQFNEERAKIQFEEYKKNYF
EGALGEDDNLDFSQNTVTDKEYLLEKISSSTKSSERGYVHYIVQLQGDKISYEAACNLFA
KNPYDSILFQKNIEDSEVAYYYNPTDSEIQEIDKYRIPDRISDRPKIKLTLIGHGKAEFN
TDIFAGLDVDSLSSEIETIIDLAKADISPKSIEINLLGCNMFSYSVNVEETYPGKLLLRV
KDKISELMPSISQDSIIVSANQYEVRINSEGRRELLDHSGEWINKEESIIKDISSKEYIS
FNPKENKIIVKSKNLPELSTLLQEIRNNSNSSDIELEEKVMLAECEINVISNIDTQVVEE
RIEEAKSLTSDSINYIKNEFKLIESISDALYDLKQQNELEESHFISFEDISETDEGFSIR
FIDKETGESIFVETEKAIFSEYANHITEEISKLKDTIFDTVNGKLVKKVNLDATHEVNTL
NAAFFIQSLIEYNSSKESLSNLSVAMKVQVYAQLFSTGLNTITDAAKVVELVSTALDETI
DLLPTLSEGLPVIATIIDGVSLGAAIKELSETSDPLLRQEIEAKIGIMAVNLTAATTAII
TSSLGIASGFSILLVPLAGISAGIPSLVNNELILRDKATKVVDYFSHISLAESEGAFTSL
DDKIMMPQDDLVISEIDFNNNSITLGKCEIWRMEGGSGHTVTNDIDHFFSSPSITYREPH
LSIYDVLEVKKEELDLSKDLMVLPNAPNRVFGWETGWTPGLRSLENDGTKLLDRIRDQYE
GQFYWRFLAFIADALITTLKPRYEDTNVRINLDSNTRSFIVPIITTEYIREKLSYSFYGS
GGTYALSLSQYNMNINIELNENDTWVIDVDNVVRDVTIESDKIKKGDLIENILSKLSIED
NKIILDNHEINFSGTLNGGNGFVSLTFSILEGINAVIEVDLLSKSYKVLISGELKTLMAN
SNSVQQKIDYIGLNSELQKNIPYSFMDDKGKENGFINCSTKEGLFVSELSDVVLISKVYM
DDSKPSFGYYSNNLKDVKVITKDNVNILTGYYLKDDIKISLSLTLQDEKTIKLNSVHLDE
SGVAEILKFMNRKGSTNTSDSLMSFLESMNIKSIFVNFLQSNIKFILDANFIISGTTSIG
QFEFICDKDNNIQPYFIKFNTLETKYTLYVGNRQNMIVEPNYDLDDSGDISSTVINFSQK
YLYGIDSCVNKVIISPNIYTDEINITPIYEANNTYPEVIVLDTNYISEKININDLSIR
YVWSNDGSDFILMSTDEENKVSQVKIRFTNVFKGNTISDKISFNFSDKQDVSINKIISTF
TPSYYVEGLLNYDLGLISLYNEKFYINNFGMMVSGLVYINDSLYYFKPPIKNLITGFTTI
GDDKYYFNPDNGGAASVGETIIDGKNYYFSQNGVLQTGVFSTEDGFKYFAPADTLDENLE
GEAIDFTGKLTIDENVYYFGDNYRAAIEWQTLDDEVYYFSTDTGRAFKGLNQIGDDKFYF
NSDGIMQKGFVNINDKTFYFDDSGVMKSGYTEIDGKYFYFAENGEMQIGVFNTADGFKYF
AHHDEDLGNEEGEALSYSGILNFNNKIYYFDDSFTAVVGWKDLEDGSKYYFDEDTAEAYI
GLSLINDGQYYFNDDGIMQVGFVAINDKVFYFSDSGIIESGVQNIDDNYFYIDEKGIVQI
GVFDTSDGYKYFAPANTVNDNIYGQAVEYSGLVRVGEDVYYFGETYTIETGWIYDMENES
DKYYFDPETKKACKGINTIHDIKYYFDETGIMRTGLITFENNHYYFNEDGEMQYGYLNIE
DKMFYFSEDGIMQIGVFNTPDGFKYFAHQNTLDENFEGESINYTGWLDLDEKRYYFTDEY
IAATGSVIIDGEEYYFDPDTAQLVISE* (SEQ ID NO: 818)

FIG. 2 (continued)

>TcdB020
MSLVNRKQLEKMANVRFRVQEDEYVAILDALEEYHNMSENTVVEKYLKLKDINSLTDTYI
DTYKKSGRNKALKKFKEYLVTEILELKNSNLTPVEKNLHFIWIGGQINDTAINYINQWKD
VNSDYNVNVFYDSNAFLINTLKKTIIESASNDTLESFRENLNDPEFNHTAFFRKRMQIIY
DKQQNFINYYKAQKEENPDLIIDDIVKTYLSNEYSKDIDELNAYIEESLNKVTENSGNDV
RNFEEFKTGEVFNLYEQELVERWNLAGASDILRVAILKNIGGVYLDVDMLPGIHPDLFKD
INKPDSVKTAVDWEEMQLEAIMKYKEYIPEYTSKHFDTLDEEVQSSFESVLASKSDKSEI
FLPLGDIEVSPLEVKIAFAKGSIINQALISAKDSYCSDLLIKQIQNRYKILNDTLGPIIS
QGNDFNTTMNNFGESLGAIANEENISFIAKIGSYLRVGFYPEANTTITLSGPTIYAGAYK
DLLTFKEMSIDTSILSSELRNFEFPKVNISQATEQEKNSLWQFNEERAKIQFEEYKKNYF
EGALGEDDNLDFSQNTVIDKEYLLEKISSSTKSSERGYVHYIVQLQGDKISYEAACNLFA
KNPYDSILFQKNIEDSEVAYYYNPTDSEIQEIDKYRIPDRISDRPKIKLTLIGHGKAEFN
TDIFAGLDVDSLSSEIETIIDLAKADISPKSIEINLLGCNMFSYSVNVEETYPGKLLLRV
KDKVSELMPSISQDSIIVSANQYEVRINSEGRRELLDHSGEWINKEESIIKDISSKEYIS
FNPKENKIIVKSKNLPELSTLLQEIRNNSNSSDIELEEKVMLAECEINVISNIETQVVEE
RIEEAKSLTSDSINYIKNEFKLIESISDALYDLKQQNELEESHFISFEDISETDEGFSIR
FIDKETGESIFVETEKAIFSEYANHITEEISKIKGTIFDTVNGKLVKKVNLDATHEVNTL
NAAFFIQSLIEYNSSKESLSNLSVAMKVQVYAQLFSTGLNTITDAAKVVELVSTALDETI
DLLPTLSEGLPVIATIIDGVSLGAAIKELSETSDPLLRQEIEAKIGIMAVNLTAATTAII
TSSLGIASGFSILLVPLAGISAGIPSLVNNELILRDKATKVVDYFSHISLAESEGAFTSL
DDKIMMPQDDLVISEIDFNNNSITLGKCEIWRMEGGSGHTVTDDIDHFFSSPSITYREPH
LSIYDVLEVKKEELDLSKDLMVLPNAPNRVFGWETGWTPGLRGLENDGTKLLDRIRDQYE
GQFYWRFFAFIADALITTLKPRYEDTNVRISLDSNTRSFIVPVITTEYIREKLSYSFYGS
GGTYALSLSQYNMNINIELNENDTWVIDVDNVVRSVTIESDKIKKGDLIENILSKLSIED
NKIILDNHEINFSGTLNGGNGFVSLTFSILEGINAVIEVDLLSKSYKVLISGELKTLMAN
SNSVQQKIDYIGLNSELQKNIPYSFMDDKGKENGFINCSTKEGLFVSELSDVVLIIKVYM
DNSKPPFGYYSNDLKDVKAITKDDVIILTGYYLKDDIKISLSFTIQDKNTIKLNGVYLDE
NGVAEILKFMNKKGSTNTSDSLMSFLESMNIKSIFIKSLKSNAKLILDTNFIISGTTSIG
QFEFICDKDNNIQPYFIKFNTLETKYTLYVGNRQNMIVEPNYDLDDSGDISSTVINFSQK
YLYGIDSCVNKVIISPNIYTDEINITPIYEANNTYPEVIVLDTNYISEKININDLSIR
YVWSNDGSDFILMSTDEENKVSQVKIRFTNVFKGNTISDKISFNFSDKQDVSINKIISTF
TPSYYVEGLLNYHLGLISLYNEKFYINNFGMMVSGLVYINDSLYYFKPPIKNLITGFTTI
GDDKYYFNPDNGGAASVGETIIDGKNYYFSPNGVLQTGVFSTEDGFKYFAPADTLDENLE
GEAIDFTGKLIIDENVYYFGDNYRAAIEWQTLDDEVYYFSTDTGRAFKGLNQIGDDKFYF
NSDGIMQKGFVNINDKTFYFDDSGVMKSGYTEIDGKHFYFAENGEMQIGVFNTADGFKYF
AHHDEDLGNEEGEALSYSGILNFNNKIYYFDDSFTAVVGWKDSEDGSKYYFDEDTAEAYI
GISTINDGKYYFNDSGIMQIGFVTINNEVFYFSDSGIVESGMQNIDDNYFYIDENGLVQI
GVFDTSDGYKYFAPANTVNDNIYGQAVEYSGLVRVGEDVYYFGETYTIETGWIYDMENES
DKYYFDPETKKAYKGINVIDDIKYYFDENGIMRTGLITFEDNHYYFNEDGIMQYGYLNIE
DKMFYFSEDGIMQIGVFNTPDGFKYFAHQNTLDENFEGESINYTGWLDLDEKRYYFTDEY
IAATGSVIIDGEEYYFDPDTAQLVISE* (SEQ ID NO: 819)

FIG. 2 (continued)

>TcdB021

MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEIFKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDYKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 820)

FIG. 2 (continued)

>TcdB023
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGISLGAAIKELSETSDPLLRQEIEAKIGIMAVNLTTATTAIIT
SSLGVASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDYKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 821)

FIG. 2 (continued)

>TcdB024
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETEEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKVMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKLSFGYYSNNLKDVKVITKDNVNILTGCYLKDDIKISLSLTLQDEKTIKLNSVHLDES
GVAEILKFMNRKGSTNTSDSLMSFLESMNIKSIFVNLLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVVVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFEDNYRGAVEWKELDGEMHYFSPETGKAFKGLNQIGDDKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 822)

FIG. 2 (continued)

>TcdB026
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETEEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGDVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPISEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFEDNYRGAVEWKELDGEMHYFSPETGKAFKGLNQIGDDKYYFN
SDGVMQKGFVSINDNKHYFDDSGVMKVGYTEIDGKYFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDEKGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 823)

FIG. 2 (continued)

>TcdB027
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTIVESATNDTLESFRENLNDPRFDYNKFYRKRMEIIY
DKQKNFINYYKTQREENPDLIIDDIVKIYLSNEYSKDIDELNSYIEESLNKVTENSGNDV
RNFEEFKGGESFKLYEQELVERWNLAAASDILRISALKEVGGVYLDVDMLPGIQPDLFES
IEKPSSVTVDFWEMVKLEAIMKYKEYIPGYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNAFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKKNYFE
GSLGEDDNLDFSQNTVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGLDVDSLSTEIETAIDLAKEDISPKSIEINLLGCNMFSYSVNVEETYPGKLLLRVK
DKISELMPSISQDSIIVSANQYEVRINSEGRRELLDHSGEWINKEESIIKDISSKEYISF
NPKENKIIVKSKNLPELSTLLQEIRNNSNSSDIELEEKVMLAECEINVISNIDTQVVEER
IEEAKSLTSDSINYIKNEFKLIESISDALYDLKQQNELEESHFISFEDISETDEGFSIRF
IDKETGESIFVETEKAIFSEYANHITEEISKIKGTIFDTVNGKLVKKVNLDATHEVNTLN
AAFFIQSLIEYNSSKESLSNLSVAMKVQVYAQLFSTGLNTITDAAKVVELVSTALDETID
LLPTLSEGLPVIATIIDGVSLGAAIKELSETSDPLLRQEIEAKIGIMAVNLTAATTAIIT
SSLGIASGFSILLVPLAGISAGIPSLVNNELILRDKATKVVDYFSHISLAESEGAFTSLD
DKIMMPQDDLVISEIDFNNNSITLGKCEIWRMEGGSGHTVTDDIDHFFSSPSITYREPHL
SIYDVLEVKKEELDLSKDLMVLPNAPNRVFGWETGWTPGLRGLENDGTKLLDRIRDQYEG
QFYWRFFAFIADALITTLKPRYEDTNVRISLDSNTRSFIVPVITTEYIREKLSYSFYGSG
GTYALSLSQYNMNINIELNENDTWVIDVDNVVRDVTIESDKIKKGDLIENILSKLSIEDN
KIILDNHEINFSGTLNGGNGFVSLTFSILEGINAVIEVDLLSKSYKVLISGELKTLMANS
NSVQQKIDYIGLNSELQKNIPYSFMDDKGKENGFINCSTKEGLFVSELSDVVLIIKVYMD
NSKPPFGYYSNDLKDVKAITKDDVIILTGYYLKDDIKISLSFTIQDENTIKLNGVYLDEN
GVAEILKFMNKKGSTNTSDSLMSFLESMNIKSIFINSLQSNTKLILDTNFIISGATSIGQ
FEFICDKDNNIQPYFIKFNTLETKYTLYVGNRQNMIVEPNYDLDDSGDISSTVINFSQKY
LYGIDSCVNKVIISPNIYTDEINITPIYEANNTYPEVIVLDTNYISEKININNDLSIRY
VWSNDGSDFILMSTDEENKVSQVKIRFTNVFKGNTISDKISFNFSDKQDVSINKIISTFT
PSYYVEGLLNYHLGLISLYNEKFYINNFGMMVSGLVYINDSLYYFKPPIKNLITGFTTIG
DDKYYFNPDNGGAASVGETIIDGKNYYFSQNGVLQTGVFSTEDGFKYFAPADTLDENLEG
EAIDFTGKLTIDENVYYFGDNYRAAIEWQTLDDEVYYFSTDTGRAFKGLNQIGDDKFYFN
SDGIMQKGFVNINDKTFYFDDSGVMKSGYTEIDGKYFYFAENGEMQIGVFNTADGFKYFA
HHDEDLGNEEGEALSYSGILNFNNKIYYFDDSFTAVVGWKDLEDGSKYYFDEDTAEAYIG
ISIINDGKYYFNDSGIMQIGFVTINNEVFYFSDSGIVESGMQNIDDNYFYIDENGLVQIG
VFDTSDGYKYFAPANTVNDNIYGQAVEYSGLVRVGEDVYYFGETYTIETGWIYDMENESD
KYYFDPETKKAYKGINVIDDIKYYFDENGIMRTGLITFEDNHYYFNEDGIMQYGYINIED
KMFYFNEDGVMQIGVFNTADGFKYFAHQNTLDENFEGESINYTGWLDLDEKRYYFTDEYI
AAIGSVIIDGEEYYFDPDTAELVISE* (SEQ ID NO: 824)

FIG. 2 (continued)

>TcdB028
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEGISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGVASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDYKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 825)

FIG. 2 (continued)

>TcdB029
MSLVNRKQLEKMANVKFRTQEDEYVAILDALEEYHNMSENTVVEKYLKLKDINSLTDAYI
DTYKKSGRNKALKKFKEYLTTEVIELKNSNLTPVEKNLHFVWIGGQISDTAINYINQWKD
VNSDYNTNVFYDSNAFLINTLKKTIVEATTNDTLESFSENLNDPRFDHNNFYRKRMEMIY
DKQKNFINYYKAQREENPELIIDDIVKTYLSNEYSKEIDELNAYIEESLNKITQNSGNDV
RNFEEFKNGESFKLYEQELVERWNLAAASDILRISALKEIGGVYLDVDMLPGIQPDLFES
IEKPSSVTVDFWEMTKLEAIMKYKEYIPGYTSEHFDMLDEEVQSSFESALASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEDSMNIHLIEADLRNFEISKTNISQSTEQEMASLWSFDDARAKAQFEEYKRNYFE
GALGEDDNLDFSQNTVVDKEYLLEKISSLARSSERGYIHYIVQLQGDKISYEAACNLFAK
TPYDSILFQKNIEDSEIAYYYNPGDDEIQEIDKYRIPSIISDRPKIKLTFIGHGKDEFNT
DIFAGLDVDSLSTEIETVIDLAKEDISPKAIEINLLGCNMFSYSINIEETYPGKLLLKVK
DKISELMPSISQDSIIVSANQYEVRINSEGRRELLDHSGEWINKEESIIKDISSKEYISF
NSKENKIIVKSKNLPELSTLLQEIRNNSNSSDIELEEKVMLAECEINVISNIDTQIVEER
IEEAKNLTSDSINYIKNEFKLIESISDALCDLKQQNELEDSHFISFEDISETDEGFSIRF
INKETGESIFVETEKTIFSEYANHITEEISKVKDTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPVIATIIDGVSLGSAIKELSETSDPLLRQEIEAKIGIMAVNLTAATTAIIT
SALGIASGFSILLVPLAGISAGIPSLVNNELILRDKATKVVDYFKHISLAETEGAFTLLD
DKIIMPQDDLVISEIDFNNNSITLGKCEIWRMEGGSGHTVTDDIDHFFSSPSITYREPYL
SIYDVLEVQKEELDLSKDLMVLPNAPNRVFAWETGWTPGLRSLENDGTKLLDRIRNHYEG
EFYWRYFAFIADALITTLKPRYEDTNIRINLDSNTRSFVVPVITTEYIRENLSYSFYGSG
GTYALSLSQYNMGINIELSESDVWIIDVDNVVRDVTIESDKIKKGDLIEGILSTLSIEDN
KIILNSHELNFSGDVNGSNGFVSLTFSILEGINAIIEVDLLSKSYKLLLSGELKTLMSNS
NYIQQKIDYIGFNSELQKNIPYSFVDAEGKKNGFINVSTKEGLFASELSDVVLISKVYMD
NSKPSFGHYSDILKDVKVITKDDINILTGYYLKDDIKISLSFTLQDEHTIKLNGVHLDEK
GVAEILTFMNKKVGTNTSDSLMSFLKSMNINNVFSHSLQDKVNLVLETNFIISGMTSIGQ
FEFICDENDNIQPYFIKFNALDTKYTLYLGNRQNMIVEPNYDLDDSGNISSTVINFSQKH
LYGIDSFINKVIISPNLYTDEINITPVHETNNTYPEVIVLDANYISEKIKVNINDLSIRY
IWSNDGNDFILMSTIGEDKASQVKIRFANVFKGNTLANKLSFNFSDKQDVSLSEIISAFT
PSKYEDGFSSYKLGLISFYNEKFYINNFGMKVSGLIYINDSLYYFKPPVNNLITGFTTVG
DDKYYFNPTNGGAASIGDTIIDDKNYYFNQIGVLQTGVFSTEDGFKYFAPANTLDENLEG
EAIDFTGKLIIDENIYYFEDNYRGAVEWKELDGEMYYFSPETGKAFKGLNQIGDDKYYFN
SDGIMQKGFVSINDKKHYFDDSGVMKVGYTEIDGKYFYFAENGEMQIGVFNTSDGFKYFA
HYNEDLGNEEGEALSYSGILNFNNKIYYFDDSFTAVVGWRNLDDGSKYYFDENTAEAFIG
FSLINDEQYYFNEDGIMQVGFVTINDRVFYFSDSGIIESGVQNIDDNYFYIDEKGIVQIG
VFDTSDGYKYFAPPNTVNENIYGQAVEYSGLVKVNEDVYYFGETYLIETGWIYDMENESD
KYYFDPETKKAYKGINVINDTKYYFDENGIMRTGLISFENNHYYFNEDGVMQSGYINIED
KMFYFSEDGIMQIGVFNTPDGFKYFAHQNTLDDNFEGESINYTGWLDFNEKRYYFTDEYI
AATGSVTIDDEEYYFDPDTAELVLSE* (SEQ ID NO: 826 )

FIG. 2 (continued)

>TcdB030
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTIVESATNDTLESFRENLNDPEFNHTAFFRKRMQIIY
DKQQNFINYYKAQKEENPDLIIDDTVKSYLSDEYSKDIDELNAYIEESLNKIAENSGNDV
RNFEEFKDGEVFNLYEQELVERWNLAAASDILRVAILKNIGGVYLDVDMLPGIHPDLFKN
INKPDSVKTAVDWEEMQLEAIMKYKEYIPEYTSKHFDTLDEEVQSSFESVLASKSDKSEI
FLPLGDIEVSPLEVKIAFAKGSIINQALISVKDSYCSDLLIKQIQNRYKILNDTLGPIIS
QGNDFNTTMNSFGESLGAISSEDNISFIAKIGSYLRVGFYPEANTTITLSGPTVYAGAYK
DLLTFKEISLDTSILTSELRNFEFPKDNISQATEQEKNSLWQFNEERAKIQFEEYKRAYF
EGALGEDDNLDFSQNIVTDKEYLLEKISSSTKSSERGYVHYIVQLQGDKISYEAACNLFA
KNPYDSILFQKNIEDSEIAYYYNPADGEIQEIDKYRIPDRISDRPKIKLTFIGHGKDEFN
TDIFAGLDVDSLSTEIETAIDLAKEDISSKSIEINLLGCNMFSYSINVEETYPGKLLLKV
KDKISELMPSISQDSIIVSANQYEVRINSEGRRELLDHSGEWINKEESIIKDISSKEYIS
FNPKENKITVKSKNLPELSILLQEIRNNSNLSDIELEEKVMLAECEINVISNIDTQIVEE
RIEEAKNLTSDSINYIKNEFKLIESISDSLYDLKQQNELDDSHFISFEDISKTEDGFSIR
FINKETGESIFVETEKEIFSEYANHIEREISNIKDTIFDTVNGKLVKKVNLDAIHEVNTL
NAAFFIQSLIGYSSSKESLSNLSVAMKVQVYAQLFSTGLNTITDAAKVVELVSTALDETI
DLLPTLSEGLPVIATIIDGVSLGAAIKELSETSDPLLRQEIEAKIGIMAVNLTAATTAII
TSSLGIASGFSILLVPLAGISAGIPSLVNNELVLRDKATKVVDYFKHISLVETEGAFTLL
DDKIMIPQDDLVISEIDFNNNSIVLGKCEIWRMEGGSGHTVTNDIDHFFSSPTITYIKPH
LSIYDVLEVQKEELDLSKDLMVLPNAPNRVFAWETGWTPGLRSLENEGTKLLDRIRDHYK
GEFYWRYFAFIADALITTLKPRYEDTNIRINLDSNNRSFIVPIITTEHIREKLSYSFHGS
GGTYALSLSQYNMGINIELSESDVWIIDVDNVVRDVTIDSDKIKKGDLIEGILSTLSIED
NKIILNHHEINFSGDVNGSNGFISLTFSILEGINAIIEVDLLSKSYKLLISGELKILMLN
SNHIQQKIDYIGFNSELQKNIPYSFVDSEGKENGFINGSTKEGLFVSELPDVVLISKVYM
DDSKPSFGYYSNNLKDVKVITKDNVNILTGYYLKDDIKISLSFTLQDEKTIKLNGVHLDE
SGVAEILKFMNKKGSTNTSDSLMSFLESVNIKSIFVNFLQSKINFILDANFIISGTTSIG
QFEFICDENDNIQPYFIKFNTLETTYTLYVGNRQNMIVEPNYDLDDSGDISSTVINFSQK
YLYGIDSCVNKVVISPNIYTDEINITPVYETNNNYPEVIVLDANYINEKINVNINDLSIR
YVWSNDGNDFILMSTSEENKVSQVKIRFVNVFKDKTLANKLSFNFSDKQDVPVSEIISAF
TPSYYEDGLIGYDLGLVSLYNEKFYINNFGMMVSGLIYINDSLYYFKPPVNNLITGFVTV
GDDKYYFNPTNGGAASIGETIIDDKNYYFNQSGILQTGVFSTEDGLKYFAPANTLDENLE
GEAIDFTGKLIIDENIYYFEDNYRGAVEWKELDGEMYYFSPETGKAFKGLNQIGDDKYYF
NSDGIMQKGFVSINDKKYYFDDSGVMKVGYIEIDGKYFYFAENGEMQIGVFNTSDGFKYF
AHHNEDLGNEEGEAISYSGILNFNNKIYYFDYSFTAVVGWKDLEDGSKYYFDEDTAEAYV
GLSLINDGQYYFNDDGIMQVGFVTINNKVFYFSDSGIIESGVQNIDDNYFYIDEKGIVQI
GVFDTSDGYKYFAPANTVNDNIYGQAVDYSGLVRVGEDIYYFGETYTIETGWIYDMENES
DKYYFNPETKKACKGINLIDDIKYYFDENGIMRTGLISFENNDYYFNENGEMHFGYINIE
DKMFYFGEDGVMQIGVFNTPDGFKYFAHQNTLDENFEGESINYTGWLDLEGKRYYFTDEY
IAATGTVTIDGEEYYFDPDTAELVVSE* (SEQ ID NO: 827)

FIG. 2 (continued)

>TcdB031
MSLVNRKQLEKMANVRFRVQEDEYVAILDALEEYHNMSENTVVEKYLKLKDINSLTDTYI
DTYKKSGRNKALKKFKEYLVTEILELKNSNLTPVEKNLHFIWIGGQINDTAINYINQWKD
VNSDYNVNVFYDSNAFLINTLKKTIIESASNDTLESFRENLNDPEFNHTAFFRKRMQIIY
DKQQNFINYYKVQKEENPDLIIDDIVKTYLSNEYSKDIDELNAYIEESLNKVTENSGNDV
RNFEEFKTGEVFNLYEQELVERWNLAGASDILRVAILKNIGGVYLDVDMLPGIHPDLFKD
INKPDSVKTAVDWEEMQLEAIMKYKEYIPEYTSKHFDTLDEEVQSSFESVLASKSDKSEI
FLPLGDIEVSPLEVKIAFAKGSIINQALISAKDSYCSDLLIKQIQNRYKILNDTLGPIIS
QGNDFNTTMNNFGESLGAIANEENISFIAKIGSYLRVGFYPEANTTITLSGPTIYAGAYK
DLLTFKEMSIDTSILSSELRNFEFPKVNISQATEQEKNSLWQFNEERAKIQFEEYKKNYF
EGALGEDDNLDFSQNTVTDKEYLLEKISSSTKSSERGYVHYIVQLQGDKISYEAACNLFA
KTPYDSVLFQKNIEDSEIAYYYNPGDGEIQEIDKYKIPSIISDRPKIKLTFIGHGKDEFN
TDIFAGLDVDSLSTEIETAIGLAKEDISPKSIEINLLGCNMFSYSVNVEETYPGKLLLRV
KDKVSELMPSISQDSIIVSANQYEVRINSEGRRELLDHSGEWINKEESIIKDISSKEYIS
FNPKENKIIVKSKNLPELSTLLQEIRNNSNSSDIELEEKVMLAECEINVISNIDTQVVEE
RIEEAKSLTSDSINYIKNEFKLIESISDALYDLKQQNELEESHFISFEDISETDEGFSIR
FIDKETGESIFVETEKAIFSEYANHITEEISKLKDTIFDTVNGKLVKKVNLDATHEVNTL
NAAFFIQSLIEYNSSKESLSNLSVAMKVQVYAQLFSTGLNTITDAAKVVELVSTALDETI
DLLPTLSEGLPVIATIIDGVSLGAAIKELSETSDPLLRQEIEAKIGIMAVNLTAATTAII
TSSLGIASGFSILLVPLAGISAGIPSLVNNELILRDKATKVVDYFSHISLAESEGAFTSL
DDKIMMPQDDLVISEIDFNNNSITLGKCEIWRMEGGSGHTVTNDIDHFFSSPSITYREPH
LSIYDVLEVKKEELDLSKDLMVLPNAPNRVFGWETGWTPGLRSLENDGTKLLDRIRDQYE
GQFYWRFLAFIADALITTLKPRYEDTNVRISLDSNTRSFIVPVITTEYIREKLSYSFYGS
GGTYALSLSQYNMNINIELNENDTWVIDVDNVVRDVTIESDKIKKGDLIENILSKLSIED
NKIILDNHEINFSGTLNGGNGFVSLTFSILEGINAVIEVDLLSKSYKVLISGELKTLMAN
SNSVQQKIDYIGLNSELQKNIPYSFMDDKGKENGFINCSTKEGLFVSELSDVVLISKVYM
DNSKPLFGYCSNDLKDVKVITKDDVIILTGYYLKDDIKISLSFTIQDENTIKLNGVYLDE
NGVAEILKFMNKKGSTNTSDSLMSFLESMNIKSIFINSLQSNTKLILDTNFIISGATSIG
QFEFICDKDNNIQPYFIKFNTLETKYTLYVGNRQNMIVEPNYDLDDSGDISSTVINFSQK
YLYGIDSCVNKVIISPNIYTDEINITPVYEANNTYPEVIVLDTNYISEKININDLSIR
YVWSNDESDFILMSTDEENKVSQVKIRFTNVFKGNTISDKISFNFSDKQDVSINKIISTF
TPSYYVEGLLNYDLGLISLYNEKFYINNFGMMVSGLVYINDSLYYFKPPIKNLITGFTTI
GDDKYYFNPDNGGAASVGETIIDGKNYYFSQNGVLQTGVFSTEDGFKYFAPADTLDENLE
GEAIDFTGKLTIDENVYYFGDNYRAAIEWQTLDDEVYYFSTDTGRAFKGLNQIGDDKFYF
NSDGIMQKGFVNINDKTFYFDDSGVMKSGYTEIDGKYFYFAENGEMQIGVFNTADGFKYF
AHHDEDLGNEEGEALSYSGILNFNNKIYYFDDSFTAVVGWKDLEDGSKYYFDEDTAEAYI
GLSLINDGQYYFNDDGIMQVGFVAINDKVFYFSDSGIIESGVQNIDDNYFYIDEKGIVQI
GVFDTSDGYKYFAPANTVNDNIYGQAVEYSGLVRVGEDVYYFGETYTIETGWIYDMENES
DKYYFDPETKKACKGINTIHDIKYYFDETGIMRTGLITFENNHYYFNEDGEMQYGYLNIE
DKMFYFSEDGIMQIGVFNTPDGFKYFAHQNTLDENFEGESINYTGWLDLDEKRYYFTDEY
IAATGSVIIDGEEYYFDPDTAQLVISE* (SEQ ID NO: 828)

FIG. 2 (continued)

>TcdB032
MSLVNRKQLEKMANVRFRVQEDEYVAILDALEEYHNMSENTVVEKYLKLKDINSLTDTYI
DTYKKSGRNKALKKFKEYLVTEILELKNSNLTPVEKNLHFIWIGGQINDTAINYINQWKD
VNSDYNVNVFYDSNAFLINTLKKTIIESASNDTLESFRENLNDPEFNHTAFFRKRMQIIY
DKQQNFINYYKAQKEENPDLIIDDIVKTYLSNEYSKDIDELNAYIEESLNKVTENSGNDV
RNFEEFKTGEVFNLYEQELVERWNLAGASDILRVAILKNIGGVYLDVDMLPGIHPDLFKD
INKPDSVKTAVDWEEMQLEAIMKYKEYIPEYTSKHFDTLDEEVQSSFESVLASKSDKSEI
FLPLGDIEVSPLEVKVAFAKGSIINQALISAKDSYCSDLLIKQIQNRYKILNDTLGPIIS
QGNDFNTTMNNFGESLGAIANEENISFIAKIGSYLRVGFYPEANTTITLSGPTIYAGAYK
DLLTFKEMSIDTSILSSELRNFEFPKVNISQATEQEKNSLWQFNEERAKIQFEEYKKNYF
EGALGEDDNLDFSQNTVTDKEYLLEKISSSTKSSERGYVHYIVQLQGDKISYEAACNLFA
KNPYDSILFQKNIEDSEVAYYYNPTDSEIQEIDKYRIPDRISDRPKIKLTLIGHGKAEFN
TDIFAGLDVDSLSSEIETIIDLAKADISPKSIEINLLGCNMFSYSVNVEETYPGKLLLRV
KDKVSELMPSISQDSIIVSANQYEVRINSEGRRELLDHSGEWINKEESIIKDISSKEYIS
FNPKENKIIVKSKNLPELSTLLQEIRNNSNSSDIELEEKVMLAECEINVISNIETQVVEE
RIEEAKSLTSDSINYIKNEFKLIESISDALYDLKQQNELEESHFISFEDISKTDEGFSIR
FIDKETGESIFVETEKAIFSEYANHITEEISKLKDTIFDTVNGKLVKKVTLDATHEVNTL
NAAFFIQSLIGYNSSKESLSNLSVAMKVQVYAQLFSTGLNTITDAAKVVELVSTALDETI
DLLPTLSEGLPVIATIIDGVSLGASIKELSETSDPLLRQEIEAKIGIMAVNLTAATTAII
TSSLGIASGFSILLVPLAGISAGIPSLVNNELILRAEAKNVVDYFGHISLAESEGAFTLL
DDKIMMPQDDLVISEIDFNNNSITLGKCEIWRMEGGSGHTVTDDIDHFFSAPSTTYREPY
LSIYDVLDVKKEELDLSKDLMVLPNAPDRIFGWERGWTPGLRSLENDGTKLLDRIRDHYE
GQFYWRFFAFIADSVITKLKPRYEDTNIRISLDSNTRSFIVPVITTEYIREKLSYSFYGS
GGTYALSLSQYNMNINIELNENDTWVIDVDNVVRDVTIESDKIKKGDLIENILSKLSIED
NKIILDNHEINFSGTLNGGNGFVSLTFSILEGINAVIEVDLLSKSYKVLISGELKTLMAN
SNSVQQKIDYIGLNSELQKNIPYSFMDDEGKENGFINCFTKEGLFVSELSDVVLIIKVYM
DNSKPPFGYYSNDLKDVKVITKDDVIILTGYYLKDDIKISLSFTIQDKNTIKLNGVYLDE
NGVAEILKFMNKKGSTNTSDSLMSFLESMNIKSIFIKSLKSNAKLILDTNFIISGTTSIG
QFEFICDKDNNIQPYFIKFNTLETKYTLYVGNRQNMIVEPNYNLDDSGDISSTVINFSQK
YLYGIDSCVNKVIISPNIYTDEINITPVHEANNTYPEVIVLDTNYISEKINININDLSIR
YVWSNDGSDFILMSTDEENKVSQVKIRFTNVFKGNTISDKISFNFSDKQDISINKIISTF
TPSYYVEGLLNYDLGLISLYNEKFYINNLGMMVSGLVYINDSLYYFKPPIKNLITGFTTI
GDDKYYFNPDNGGAASVGETIIDGKNYYFSQNGVLQTGVFSTEDGFKYFAPADTLDENLE
GEAIDFTGKLIIDENVYYFGDNYRAAIEWQTLDDEVYYFSTDTGRAFKGLNQIGDDKFYF
NSDGIMQKGFVNINDKTFYFDDSGVMKSGYTEIDGKYFYFAENGEMQIGVFNTADGFKYF
AHHDEDLGNEEGEALSYSGILNFNNKIYYFDDSFTAVVGWKDLEDGSKYYFDENTAEASI
GISIINDGKYYFNDSGIMQIGFVTINNEVFYFSDSGIVESGMQNIDDNYFYISENGLVQI
GVFDTSDGYKYFAPANTVNDNIYGQAVEYSGLVRVNEDVYSFGESYTIETGWIYDSENES
DKYYFDPETKKAYKGINVIDDIKYYFDENGIMRTGLITFEDNHYYFNEDGEMQYGYLNIE
DKMFYFSEDGIMQIGVFNTPDGFKYFAHQNTLDENFEGESINYTGWLDLDEKRYYFTDEY
IAATGSVIIDGEEYYFDPDTAQLVISE* (SEQ ID NO: 829)

FIG. 2 (continued)

>TcdB033
MSLVNRKQLEKMANVRFRVQEDEYVAILDALEEYHNMSENTVVEKYLKLKDINSLTDTYI
DTYKKSGRNKALKKFKEYLVTEILELKNSNLTPVEKNLHFIWIGGQINDTAINYINQWKD
VNSDYNVNVFYDSNAFLINTLKKTIIESASNDTLESFRENLNDPEFNHTAFFRKRMQIIY
DKQQNFINYYKVQKEENPDLIIDDIVKTYLSNEYSKDIDELNAYIEESLNKVTENSGNDV
RDFEEFKTGEVFNLYEQELVERWNLAGASDILRVAILKNIGGVYLDVDMLPGIHPDLFKD
INKPDSVKTAVDWEEMQLEAIMKYKEYIPEYTSKHFDTLDEEVQSSFESVLASKSDKSEI
FLPLGDIEVSPLEVKIAFAKGSIINQALISAKDSYCSDLLIKQIQNRYKILNDTLGPIIS
QGNDFNTTMNNFGESLGAIANEENISFIAKIGSYLRVGFYPEANTTITLSGPTIYAGAYK
DLLTFKEMSIDTSILSSELRNFEFPKVNISQATEQEKNSLWQFNEERAKIQFEEYKKNYF
EGALGEDDNLDFSQNTVTDKEYLLEKISSSTKSSERGYVHYIVQLQGDKISYEAACNLFA
KNPYDSILFQKNIEDSEVAYYYNPTDSEIQEIDKYRIPDRISDRPKIKLTLIGHGKAEFN
TDIFAGLDVDSLSSEIETIIDLAKADISPKSIEINLLGCNMFSYSVNVEETYPGKLLLRV
KDKISELMPSISQDSIIVSANQYEVRINSEGRRELLDHSGEWINKEESIIKDISSKEYIS
FNPKENKIIVKSKNLPELSTLLQEIRNNSNSSDIELEEKVMLAECEINVISNIDTQVVEE
RIEEAKSLTSDSINYIKNEFKLIESISDALYDLKQQNELEESHFISFEDISETDEGFSIR
FIDKETGESIFVETEKAIFSEYANHITEEISKLKDTIFDTVNGKLVKKVNLDATHEVNTL
NAAFFIQSLIEYNSSKESLSNLSVAMKVQVYAQLFSTGLNTITDAAKVVELVSTALDETI
DLLPTLSEGLPVIATIIDGVSLGAAIKELSETSDPLLRQEIEAKIGIMAVNLTAATTAII
TSSLGIASGFSILLVPLAGISAGIPSLVNNELILRDKATKVVDYFSHISLAESEGAFTSL
DDKIMMPQDDLVISEIDFNNNSITLGKCEIWRMEGGSGHTVTNDIDHFFSSPSITYREPH
LSIYDVLEVKKEELDLSKDLMVLPNAPNRVFGWETGWTPGLRSLENDGTKLLDRIRDQYE
GQFYWRFLAFIADALITTLKPRYEDTNVRINLDSNTRSFIVPIITTEYIREKLSYSFYGS
GGTYALSLSQYNMNINIELNENDTWVIDVDNVVRDVTIESDKIKKGDLIENILSKLSIED
NKIILDNHEINFSGTLNGGNGFVSLTFSILEGINAVIEVDLLSKSYKVLISGELKTLMAN
SNSVQQKIDYIGLNSELQKNIPYSFMDDKGKENGFINCSTKEGLFVSELSDVVLISKVYM
DNSKPLFGYCSNDLKDVKVITKDDVIILTGYYLKDDIKISLSFTIQDENTIKLNGVYLDE
NGVAEILKFMNKKGSTNTSDSLMSFLESMNIKSIFINSLQSNTKLILDTNFIISGTTSIG
QFEFICDKDNNIQPYFIKFNTLETKYTLYVGNRQNMIVEPNYDLDDSGDISSTVINFSQK
YLYGIDSCVNKVIISPNIYTDEINITPIYEANNTYPEVIVLDTNYISEKININDLSIR
YVWSNDGSDFILMSTDEENKVSQVKIRFTNVFKGNTISDKISFNFSDKQDVSINKIISTF
TPSYYVEALLNYDLGLISLYNEKFYINNFGMMVSGLVYINDSLYYFKPPIKNLITGFTTI
GDDKYYFNPDNGGAASVGETIIDGKNYYFSQNGVLQTGVFSTEDGFKYFAPADTLDENLE
GEAIDFTGKLTIDENVYYFGDNYRAAIEWQTLDDEVYYFSTDTGRAFKGLNQIGDDKFYF
NSDGIMQKGFVNINDKTFYFDDSGVMKSGYTEIDGKYFYFAENGEMQIGVFNTADGFKYF
AHHDEDLGNEEGEALSYSGILNFNNKIYYFDDSFTAVVGWKDLEDGSKYYFDEDTAEAYI
GLSLINDGQYYFNDDGIMQVGFVAINDKVFYFSDSGIIESGVQNIDDNYFYIDEKGIVQI
GVFDTSDGYKYFAPANTVNDNIYGQAVEYSGLVRVGEDVYYFGETYTIETGWIYDMENES
DKYYFDPETKKACKGINTIHDIKYYFDETGIMRTGLITFENNHYYFNEDGEMQYGYLNIE
DKMFYFSEDGIMQIGVFNTPDGFKYFAHQNTLDENFEGESINYTGWLDLDEKRYYFTDEY
IAATGSVIIDGEEYYFDPDTAQLVISE* (SEQ ID NO: 830)

FIG. 2 (continued)

\>TcdB034
MSLVNRKQLEKMANVRFRVQEDEYVAILDALEEYHNMSENTVVEKYLKLKDINSLTDTYI
DTYKKSGRNKALKKFKEYLVTEILELKNSNLTPVEKNLHFIWIGGQINDTAINYINQWKD
VNSDYNVNVFYDSNAFLINTLKKTIIESASNDTLESFRENLNDPEFNHTAFFRKRMQIIY
DKQQNFINYYKVQKEENPDLIIDDIVKTYLSNEYSKDIDELNAYIEESLNKVTENSGNDV
RNFEEFKTGEVFNLYEQELVERWNLAGASDILRVAILKNIGGVYLDVDMLPGIHPDLFKD
INKPDSVKTAVDWEEMQLEAIMKYKEYIPEYTSKHFDTLDEEVQSSFESVLASKSDKSEI
FLPLGDIEVSPLEVKIAFAKGSIINQALISAKDSYCSDLLIKQIQNRYKILNDTLGPIIS
QGNDFNTTMNNFGESLGAIANEENISFIAKIGSYLRVGFYPEANTTITLSGPTIYAGAYK
DLLTFKEMSIDTSILSSELRNFEFPKVNISQATEQEKNSLWQFNEERAKIQFEEYKKNYF
EGALGEDDNLDFSQNTVTDKEYLLEKISSSTKSSERGYVHYIVQLQGDKISYEAACNLFA
KNPYDSILFQKNIEDSEVAYYYNPTDSEIQEIDKYRIPDRISDRPKIKLTLIGHGKAEFN
TDIFAGLDVDSLSSEIETIIDLAKADISPKSIEINLLGCNMFSYSVNVEETYPGKLLLRV
KDKISELMPSISQDSIIVSANQYEVRINSEGRRELLDHSGEWINKEESIIKDISSKEYIS
FNPKENKIIVKSKNLPELSTLLQEIRNNSNSSDIELEEKVMLAECEINVISNIDTQVVEE
RIEEAKSLTSDSINYIKNEFKLIESISDALYDLKQQNELEESHFISFEDISETDEGFSIR
FIDKETGESIFVETEKAIFSEYANHITEEISKLKDTIFDTVNGKLVKKVNLDATHEVNTL
NAAFFIQSLIEYNSSKESLSNLSVAMKVQVYAQLFSTGLNTITDAAKVVELVSTALDETI
DLLPTLSEGLPVIATIIDGVSLGAAIKELSETSDPLLRQEIEAKIGIMAVNLTAATTAII
TSSLGIASGFSILLVPLAGISAGIPSLVNNELILRDKATKVVDYFSHISLAESEGAFTSL
DDKIMMPQDDLVISEIDFNNNSITLGKCEIWRMEGGSGHTVTNDIDHFFSSPSITYREPH
LSIYDVLEVKKEELDLSKDLMVLPNAPNRVFGWETGWTPGLRSLENDGTKLLDRIRDQYE
GQFYWRFLAFIADALITTLKPRYEDTNVRINLDSNTRSFIVPIITTEYIREKLSYSFYGS
GGTYALSLSQYNMNINIELNENDTWVIDVDNVVRDVTIESDKIKKGDLIENILSKLSIED
NKIILDNHEINFSGTLNGGNGFVSLTFSILEGINAVIEVDLLSKSYKVLISGELKTLMAN
SNSVQQKIDYIGLNSELQKNIPYSFMDDKGKENGFINCSTKEGLFVSELSDVVLISKVYM
DDSKPSFGYYSNNLKDVKVITKDNVNILTGYYLKDDIKISLSLTLQDEKTIKLNSVHLDE
SGVAEILKFMNRKGSTNTSDSLMSFLESMNIKSIFVNFLQSNIKFILDANFIISGTTSIG
QFEFICDKDNNIQPYFIKFNTLETKYTLYVGNRQNMIVEPNYDLDDSGDISSTVINFSQK
YLYGIDSCVNKVIISPNIYTDEINITPIYEANNTYPEVIVLDTNYISEKININDLSIR
YVWSNDGSDFILMSTDEENKVSQVKIRFTNVFKGNTISDKISFNFSDKQDVSINKIISTF
TPSYYVEGLLNYDLGLISLYNEKFYINNFGMMVSGLVYINDSLYYFKPPIKNLITGFTTI
GDDKYYFNPDNGGAASVGETIIDGKNYYFSQNGVLQTGVFSTEDGFKYFAPADTLDENLE
GEAIDFTGKLTIDENVYYFGDNYRAAIEWQTLDDEVYYFSTDTGRAFKGLNQIGDDKFYF
NSDGIMQKGFVNINDKTFYFDDSGVMKSGYTEIDGKYFYFAENGEMQIGVFNTADGFKYF
AHHDEDLGNEEGEALSYSGILNFNNKIYYFDDSFTAVVGWKDLEDGSKYYFDEDTAEAYI
GISIINDGKYYFNDSGIMQIGFVTINNEVFYFSDSGIVESGMQNIDDNYFYIDENGLVQI
GVFDTSDGYKYFAPANTVNDNIYGQAVEYSGLVRVGEDVYYFGETYTIETGWIYDMENES
DKYYFDPETKKAYKGINVIDDIKYYFDENGIMRTGLITFEDNHYYFNEDGIMQYGYLNIE
DKTFYFSEDGIMQIGVFNTPDGFKYFAHQNTLDENFEGESINYTGWLDLDEKRYYFTDEY
IAATGSVIIDGEEYYFDPDTAQLVISE* (SEQ ID NO: 831)

FIG. 2 (continued)

>TcdB035

MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTIVESATNDTLESFRENLNDPEFNHTAFFRKRMQIIY
DKQQNFINYYKAQKEENPDLIIDDTVKSYLSDEYSKDIDELNAYIEESLNKIAENSGNDV
RNFEEFKDGEVFNLYEQELVERWNLAAASDILRVAILKNIGGVYLDVDMLPGIHPDLFKN
INKPDSVKTAVDWEEMKLEAIMKYKEYIPEYTSKHFDTLDEEVQSSFESVLASKSDKSEI
FLPLGDIEVSPLEVKIAFAKGSIINQALISVKDSYCSDLLIKQIQNRYKILNDTLGPIIS
QGNDFNTTMNSFGESLGAISSEDNISFIAKIGSYLRVGFYPEANTTITLSGPTVYAGAYK
DLLTFKEISLDTSILTSELRNFEFPKDNISQATEQEKNSLWQFNEERAKIQFEEYKRAYF
EGALGEDDNLDFSQNTVTDKEYLLEKISSSTKSSERGYVHYIVQLQGDKISYEAACNLFA
KNPYDSILFQKNIEDSEIAYYYNPADGEIQEIDKYRIPDRISDRPKIKLTFIGHGKDEFN
TDIFAGLDVDSLSTEIETAIDLAKEDISSKSIEINLLGCNMFSYSINVEETYPGKLLLKV
KDKISELMPSISQDSIIVSANQYEVRINSEGRRELLDHSGEWINKEESIIKDISSKEYIS
FNPKENKITVKSKNLPELSTLLQEIRNNSNLSDIELEEKVMLAECEINVISNIDTQIVEE
RIEEAKNLTSDSINYIKNEFKLIESISDSLYDLKQQNELDDSHFISFEDISKTEDGFSIR
FINKETGESIFVETEKEIFSEYANHIEREISNIKDTIFDTVNGKLVKKVNLDAIHEVNTL
NAAFFIQSLIGYSSSKESLSNLSVAMKVQVYAQLFSTGLNTITDAAKVVELVSTALDETI
DLLPTLSEGLPVIATIIDGVSLGAAIKELSETSDPLLRQEIEAKIGIMAVNLTAATTAII
TSSLGIASGFSILLVPLAGISAGIPSLVNNELVLRDKATKVVDYFKHISLVETEGAFTLL
DDKIMIPQDDLVISEIDFNNNSIVLGKCEIWRMEGGSGHTVTNDIDHFFSSPTITYIKPH
LSIYDVLEVQKEELDLSKDLMVLPNAPNRVFAWETGWTPGLRSLENEGTKLLDRIRDHYK
GEFYWRYFAFIADALITTLKPRYEDTNIRINLDSNNRSFIVPIITTEHIREKLSYSFHGS
GGTYALSLSQYNMGINIELSESDVWIIDVDNVVRDVTIDSDKIKKGDLIEGILSTLSIED
NKIILNHHEINFSGDVNGSNGFISLTFSILEGINAIIEVDLLSKSYKLLISGELKILMLN
SNHIQQKIDYIGFNSELQKNIPYSFVDSEGKENGFINGSTKEGLFVSELPDVVLISKVYM
DDSKPSFGYYSNNLKDVKVITKDNVNILTGYYLKDDIKISLSFTLQDEKTIKLNGVHLDE
SGVAEILKFMNKKGSTNTSDSLMSFLESVNIKSIFVNFLQSKINFILDANFIISGTTSIG
QFEFICDENDNIQPYFIKFNTLETTYTLYVGNRQNMIVEPNYDLDDSGDISSTVINFSQK
YLYGIDSCVNKVVISPNIYTDEINITPVYETNNNYPEVIVLDANYINEKINVNINDLSIR
YVWSNDGNDFILMSTSEENKVSQVKIRFVNVFKDKTLANKLSFNFSDKQDVPVSEIISAF
TPSYYEDGLIGYDLGLVSLYNEKFYINNFGMMVSGLIYINDSLYYFKPPVNNLITGFVTV
GDDKYYFNPTNGGAASIGETIIDDKNYYFNQSGILQTGVFSTEDGLKYFAPANTLDENLE
GEAIDFTGKLIIDENIYYFEDNYRGAVEWKELDGEMYYFSPETGKAFKGLNQIGDDKYYF
NSDGIMKKGFVSINDKKYYFDDSGVMKVGYIEIDGKYFYFAENGEMQIGVFNTSDGFKYF
AHHNEDLGNEEGEAISYSGILNFNNKIYYFDYSFTAVVGWKDLEDGSKYYFDEDTAEAYV
GLSLINDGQYYFNDDGIMQVGFVTINNKVFYFSDSGIIESGVQNIDDNYFYIDEKGIVQI
GVFDTSDGYKYFAPANTVNDNIYGQAVDYSGLVRVGEDIYYFGETYTIETGWIYDMENES
DKYYFNPETKKACKGINLIDDIKYYFDENGIMRTGLISFENNDYYFNENGEMHFGYINIE
DKMFYFGEDGVMQIGVFNTPDGFKYFAHQNTLDENFEGESINYTGWLDLEGKRYYFTDEY
IAATGTVTIDGEEYYFDPDTAELVVSE* (SEQ ID NO: 832)

>TcdB036

FIG. 2 (continued)

MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISISLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VVWSNDGNDFILMSTSEENKVSQVKIRFVNIFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDDKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 833)

FIG. 2 (continued)

>TcdB037

MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEIFKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDYKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFGEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 834)

FIG. 2 (continued)

>TcdB038
MSLVNRKQLEKMANVRFRVQEDEYVAILDALEEYHNMSENTVVEKYLKLKDINSLTDTYI
DTYKKSGRNKALKKFKEYLVTEILELKNSNLTPVEKNLHFIWIGGQINDTAINYINQWKD
VNSDYNVNVFYDSNAFLINTLKKTIIESASNDTLESFRENLNDPEFNHTAFFRKRMQIIY
DKQQNFINYYKAQKEENPDLIIDDIVKTYLSNEYSKDIDELNAYIEESLNKVTENSGNDV
RNFEEFKTGEVFNLYEQELVERWNLAGASDILRVAILKNIGGVYLDVDMLPGIHPDLFKD
INKPDSVKTAVDWEEMQLEAIMKYKEYIPEYTSKHFDTLDEEVQSNFESVLASKSDKSEI
FLPLGDIEVSPLEVKVAFAKGSIINQALISAKDSYCSDLLIKQIQNRYKILNDTLGPIIS
QGNDFNTTMNNFGESLGAIANEENISFIAKIGSYLRVGFYPEANTTITLSGPTIYAGAYK
DLLTFKEMSIDTSILSSELRNFEFPKVNISQATEQEKNSLWQFNEERAKIQFEEYKKNYF
EGALGEDDNLDFSQNTVTDKEYLLEKISSSTKSSERGYVHYIVQLQGDKISYEAACNLFA
KNPYDSILFQKNIEDSEVAYYYNPTDSEIQEIDKYRIPDRISDRPKIKLTLIGHGKAEFN
TDIFAGLDVDSLSSEIETIIDLAKADISPKSIEINLLGCNMFSYSVNVEETYPGKLLLRV
KDKVSELMPSISQDSIIVSANQYEVRINSEGRRELLDHSGEWINKEESIIKDISSKEYIS
FNPKENKIIVKSKNLPELSTLLQEIRNNSNSSDIELEEKVMLAECEINVISNIETQVVEE
RIEEAKSLTSDSINYIKNEFKLIESISDALYDLKQQNELEESHFISFEDISKTDEGFSIR
FIDKETGESIFVETEKAIFSEYANHITEEISKLKDTIFDTVNGKLVKKVNLDATHEVNTL
NAAFFIQSLIGYNSSKESLSNLSVAMKVQVYAQLFSTGLNTITDAAKVVELVSTALDETI
DLLPTLSEGLPVIATIIDGVSLGASIKELSETSDPLLRQEIEAKIGIMAVNLTAATTAII
TSSLGIASGFSILLVPLAGISAGIPSLVNNELILRAEAKNVVDYFGHISLAESEGAFTLL
DDKIMMPQDDLVISEIDFNNNSITLGKCEIWRMEGGSGHTVTDDIDHFFSAPSTTYREPY
LSIYDVLDVKKEELDLSKDLMVLPNAPDRIFGWERGWTPGLRSLENDGTKLLDRIRDHYE
GQFYWRFFAFIADSVITKLKPRYEDTNIRISLDSNTRSFIVPVITTEYIREKLSYSFYGS
GGTYALSLSQYNMNINIELNENDTWVIDVDNVVRDVTIESDKIKKGDLIENILSKLSIED
NKIILDNHEINFSGTLNGGNGFVSLTFSILEGINAVIEVDLLSKSYKVLISGELKTLMAN
SNSVQQKIDYIGLNSELQKNIPYSFMDDEGKENGFINCFTKEGLFVSELSDVVLIIKVYM
DNSKPPFGYYSNDLKDVKVITKDDVIILTGYYLKDDIKISLSFTIQDKNTIKLNGVYLDE
NGVAEILKFMNKKGSTNTSDSLMSFLESMNIKSIFIKSLKSNAKLILDTNFIISGTTSIG
QFEFICDKDNNIQPYFIKFNTLETKYTLYVGNRQNMIVEPNYNLDDSGDISSTVINFSQK
YLYGIDSCVNKVIISPNIYTDEINITPVHEANNTYPEVIVLDTNYISEKININNINDLSIR
YVWSNDGSDFILMSTDEENKVSQVKIRFTNVFKGNTISDKISFNFSDKQDVSINKIISTF
TPSYYVEGLLNYHLGLISLYNEKFYINNFGMMVSGLVYINDSLYYFKPPIKNLITGFTTI
GDDKYYFNPDNGGAASVGETIIDGKNYYFSQNGVLQTGVFSTEDGFKYFAPADTLDENLE
GEAIDFTGKLTIDENVYYFGDNYRAAIEWQTLDDEVYYFSTDTGRAFKGLNQIGDDKFYF
NSDGIMQKGFVNINDKTFYFDDSGVMKSGYTEIDGKYFYFAENGEMQIGVFNTADGFKYF
AHHDEELGNEEGEALSYSGILNFNNKIYYFDDSFTAVVGWKDLEDGSKYYFDEDTAEAYI
GISIINDSKYYFNDSGIMQIGFVTINNEVFYFSDSGIVESGMQNIDDNYFYIDENGLVQI
GVFDTSDGYKYFAPANTVNDNIYGQAVEYSGLVRVNEDVYSFGESYTIETGWIYDSENES
DKYYFDPETKKAYKGINVIDDIKYYFDENGIMRTGLITFENNHYYFNEDGEMQYGYLNIE
DKMFYFSEDGIMQIGVFNTPDGFKYFAHQNTLDENFEGESINYTGWLDLDEKRYYFTDEY
IAATGSVIIDGEEYYFDPDTAELVISE* (SEQ ID NO: 835)

FIG. 2 (continued)

>TcdB039
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKVSELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGSTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDDKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 836)

FIG. 2 (continued)

>TcdB040
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
NKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKVMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGNNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGCYLKDDIKISLSLTLQDEKTIKLNSVHLDES
GVAEILKFMNRKGSTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFEDNYRGAVEWKELDGEMHYFSPETGKAFKGLNQIGDDKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 837)

FIG. 2 (continued)

>TcdB041
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGSTNTSDSLMSFLESMNIKSIFVNFLQSNIKFILDANFIISGTTSIGQ
FEFICDENDNIQPYFIKFNTRETNYTLYVGNRQNMIVEPNYDLDDSGDISSTVINFSQKY
LYGIDSCVNKVVISPNIYTDEINITPVYETNNTYPEVIVLDTNYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMVSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDYKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYFYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 838)

FIG. 2 (continued)

\>TcdB042

MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTVVESAINDTLESFRENLNDPRFDYNKFFRKRMEIIY
DKQKNFINYYKAQREENPELIIDDIVKTYLSNEYSKEIDELNTYIEESLNKITQNSGNDV
RNFEEFKNGESFNLYEQELVERWNLAAASDILRISALKEIGGMYLDVDMLPGIQPDLFES
IEKPSSVTVDFWEMTKLEAIMKYKEYIPEYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNTFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKRNYFE
GSLGEDDNLDFSQNIVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGFDVDSLSTEIEAAIDLAKEDISPKSIEINLLGCNMFSYSINVEETYPGKLLLKVK
DKISELMPSISQDSIIVSANQYEVRINSEGRRELLDHSGEWINKEESIIKDISSKEYISF
NPKENKITVKSKNLPELSTLLQEIRNNSNSSDIELEEKVMLTECEINVISNIDTQIVEER
IEEAKNLTSDSINYIKDEFKLIESISDALCDLKQQNELEDSHFISFEDISETDEGFSIRF
INKETGESIFVETEKTIFSEYANHITEEISKIKGTIFDTVNGKLVKKVNLDTTHEVNTLN
AAFFIQSLIEYNSSKESLSNLSVAMKVQVYAQLFSTGLNTITDAAKVVELVSTALDETID
LLPTLSEGLPIIATIIDGVSLGAAIKELSETSDPLLRQEIEAKIGIMAVNLTTATTAIIT
SSLGIASGFSILLVPLAGISAGIPSLVNNELVLRDKATKVVDYFKHVSLVETEGVFTLLD
DKIMMPQDDLVISEIDFNNNSIVLGKCEIWRMEGGSGHTVTDDIDHFFSAPSITYREPHL
SIYDVLEVQKEELDLSKDLMVLPNAPNRVFAWETGWTPGLRSLENDGTKLLDRIRDNYEG
EFYWRYFAFIADALITTLKPRYEDTNIRINLDSNTRSFIVPIITTEYIREKLSYSFYGSG
GTYALSLSQYNMGINIELSESDVWIIDVDNVVRDVTIESDKIKKGDLIEGILSTLSIEEN
KIILNSHEINFSGEVNGSNGFVSLTFSILEGINAIIEVDLLSKSYKLLISGELKILMLNS
NHIQQKIDYIGFNSELQKNIPYSFVDSEGKENGFINGSTKEGLFVSELPDVVLISKVYMD
DSKPSFGYYSNNLKDVKVITKDNVNILTGYYLKDDIKISLSLTLQDEKTIKLNSVHLDES
GVAEILKFMNRKGNTNTSDSLMSFLESMNIKSIFVNFLQSNIKFILDANFIISGTTSIGQ
FEFICDENDNIQPYFIKFNTLETNYTLYVGNRQNMIVEPNYDLDDSGDISSTVINFSQKY
LYGIDSCVNKVVISPNIYTDEINITPVYETNNTYPEVIVLDANYINEKINVNINDLSIRY
VWSNDGNDFILMSTSEENKVSQVKIRFVNVFKDKTLANKLSFNFSDKQDVPVSEIILSFT
PSYYEDGLIGYDLGLVSLYNEKFYINNFGMMLSGLIYINDSLYYFKPPVNNLITGFVTVG
DDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDDKYYFN
SDGVMQKGFVSINDNKHYFDDSGVMKVGYTEIDGKHFYFAENGEMQIGVFNTEDGFKYFA
HHNEDLGNEEGEEISYSGILNFNNKIYYFDDSFTAVVGWKDLEDGSKYYFDEDTAEAYIG
LSLINDGQYYFNDDGIMQVGFVTINDKVFYFSDSGIIESGVQNIDDNYLYIDDNGIVQIG
VFDTSDGYKYFAPANTVNDNIYGQAVEYSGLVRVGEDVYYFGETYTIETGWIYDMENESD
KYYFNPETKKACKGINLIDDIKYYFDEKGIMRTGLISFENNNYYFNENGEMQFGYINIED
KMFYFGEDGVMQIGVFNTPDGFKYFAHQNTLDENFEGESINYTGWLDLDEKRYYFTDEYI
AATGSVIIDGEEYYFDPDTAQLVISE* (SEQ ID NO: 839)

FIG. 2 (continued)

>TcdB043
MSLVNRKQLEKMANVRFRTQEDEYVAILDALEEYHNMSENTVVEKYLKLKDINSLTDIYI
DTYKKSGRNKALKKFKEYLVTEVLELKNNNLTPVEKNLHFVWIGGQINDTAINYINQWKD
VNSDYNVNVFYDSNAFLINTLKKTIVESATNDTLESFRENLNDPRFDYNKFYRKRMEIIY
DKQKNFINYYKTQREENPDLIIDDIVKIYLSNEYSKDIDELNSYIEESLNKVTENSGNDV
RNFEEFKGGESFKLYEQELVERWNLAAASDILRISALKEVGGVYLDVDMLPGIQPDLFES
IEKPSSVTVDFWEMVKLEAIMKYKEYIPGYTSEHFDMLDEEVQSSFESVLASKSDKSEIF
SSLGDMEASPLEVKIAFNSKGIINQGLISVKDSYCSNLIVKQIENRYKILNNSLNPAISE
DNDFNTTTNAFIDSIMAEANADNGRFMMELGKYLRVGFFPDVKTTINLSGPEAYAAAYQD
LLMFKEGSMNIHLIEADLRNFEISKTNISQSTEQEMASLWSFDDARAKAQFEEYKKNYFE
GSLGEDDNLDFSQNTVVDKEYLLEKISSLARSSERGYIHYIVQLQGDKISYEAACNLFAK
TPYDSVLFQKNIEDSEIAYYYNPGDGEIQEIDKYKIPSIISDRPKIKLTFIGHGKDEFNT
DIFAGLDVDSLSTEIETAIDLAKEDISPKSIEINLLGCNMFSYSVNVEETYPGKLLLRVK
DKISELMPSISQDSIIVSANQYEVRINSEGRRELLDHSGEWINKEESIIKDISSKEYISF
NPKENKIIVKSKNLPELSTLLQEIRNNSNSSDIELEEKVMLAECEINVISNIDTQVVEER
IEEAKSLTSDSINYIKNEFKLIESISDALYDLKQQNELEESHFISFEDISETDEGFSIRF
IDKETGESIFVETEKAIFSEYANHITEEISKLKDTIFDTVNGKLVKKVNLDATHEVNTLN
AAFFIQSLIEYNSSKESLSNLSVAMKVQVYAQLFSTGLNTITDAAKVVELVSTALDETID
LLPTLSEGLPVIATIIDGVSLGAAIKELSETSDPLLRQEIEAKIGIMAVNLTAATTAIIT
SSLGIASGFSILLVPLAGISAGIPSLVNNELILRDKATKVVDYFSHISLAESEGAFTSLD
DKIMMPQDDLVISEIDFNNNSITLGKCEIWRMEGGSGHTVTNDIDHFFSSPSITYREPHL
SIYDVLEVKKEELDLSKDLMVLPNAPNRVFGWETGWTPGLRSLENDGTKLLDRIRDQYEG
QFYWRFLAFIADALITTLKPRYEDTNVRISLDSNTRSFIVPVITTEYIREKLSYSFYGSG
GTYALSLSQYNMNINIELNENDTWVIDVDNVVRDVTIESDKIKKGDLIENILSKLSIEDN
KIILDNHEINFSGTLNGGNGFVSLTFSILEGINAVIEVDLLSKSYKVLISGELKTLMANS
NSVQQKIDYIGLNSELQKNIPYSFMDDKGKENGFINCSTKEGLFVSELSDVVLISKVYMD
NSKPLFGYCSNDLKDVKVITKDDVIILTGYYLKDDIKISLSFTIQDENTIKLNGVYLDEN
GVAEILKFMNKKGSTNTSDSLMSFLESMNIKSIFINSLQSNTKLILDTNFIISGATSIGQ
FEFICDKDNNIQPYFIKFNTLETKYTLYVGNRQNMIVEPNYDLDDSGDISSTVINFSQKY
LYGIDSCVNKVIISPNIYTDEINITPIYEANNTYPEVIVLDTNYISEKINININDLSIRY
VWSNDGSDFILMSTDEENKVSQVKIRFTNVFKGNTISDKISFNFSDKQDVSINKIISTFT
PSYYVEGLLNYHLGLISLYNEKFYINNFGMMVSGLVYINDSLYYFKPPIKNLITGFTTIG
DDKYYFNPDNGGAASVGETIIDGKNYYFSQNGVLQTGVFSTEDGFKYFAPADTLDENLEG
EAIDFTGKLTIDENVYYFGDNYRAAIEWQTLDDEVYYFSTDTGRAFKGLNQIGDDKFYFN
SDGIMQKGFVNINDKTFYFDDSGVMKSGYTEIDGKYFYFAENGEMQIGVFNTADGFKYFA
HHDEDLGNEEGEALSYSGILNFNNKIYYFDDSFTAVVGWKDLEDGSKYYFDEDTAEAYIG
ISIINDGKYYFNDSGIMQIGVTINNEVFYFSDSGIVESGMQNIDDNYFYIDENGLVQIG
VFDTSDGYKYFAPANTVNDNIYGQAVEYSGLVRVGEDVYYFGETYTIETGWIYDMENESD
KYYFDPETKKAYKGINVIDDIKYYFDENGIMRTGLITFEDNHYYFNEDGIMQYGYLNIED
KTFYFSEDGIMQIGVFNTPDGFKYFAHQNTLDENFEGESINYTGWLDLDEKRYYFTDEYI
AATGSVIIDGEEYYFDPDTAQLVISE* (SEQ ID NO: 840)

FIG. 6

>CDIFB IgG1

QVQLQQPGAALVKSGASVKLSCKASGYTFTSYWIHWVKQRPGQGLEWIGVINPSNGRSSYN

EKFKSKATLTVDKSSSTAYMQFNSLTSEDSAVYYCARAYYGTSYYAMDYWGQGTSVTVSSA

KTTPPSVYPLAPGSAAQTNSMVTLGCLVKGYFPEPVTVTWNSGSLSSGVHTFPAVLESDLYT

LSSSVTVPSSPRPSETVTCNVAHPASSTKVDKKIVPRDCGCKPCICTVPEVSSVFIFPPKPKD

VLTITLTPKVTCVVVDISKDDPEVQFSWFVDDVEVHTAQTQPREEQFNSTFRSVSELPIMHQD

WLNGKEFKCRVNSAAFPAPIEKTISKTKGRPKAPQVYTIPPPKEQMAKDKVSLTCMITDFFPE

DITVEWQWNGQPAENYKNTQPIMNTNGSYFVYSKLNVQKSNWEAGNTFTCSVLHEGLHNH

HTEKSLSHSPGK

DVLMTQTPLSLPVSLGDQASISCRSSQSIVHSNGNTYLEWYLQTPGQSPKLLIYKVSNRFSGV

PDRFSGSGSGTDFTLKISRVEAEDLGVYYCFQGSHFPFTFGTGTKLEIKRADAAPTVSIFPPS

SEQLTSGGASVVCFLNNFYPKDINVKWKIDGSERQNGVLNSWTDQDSKDSTYSMSSTLTLT

KDEYERHNSYTCEATHKTSTSPIVKSFNRNEC (SEQ ID NO: 841)

FIG. 7

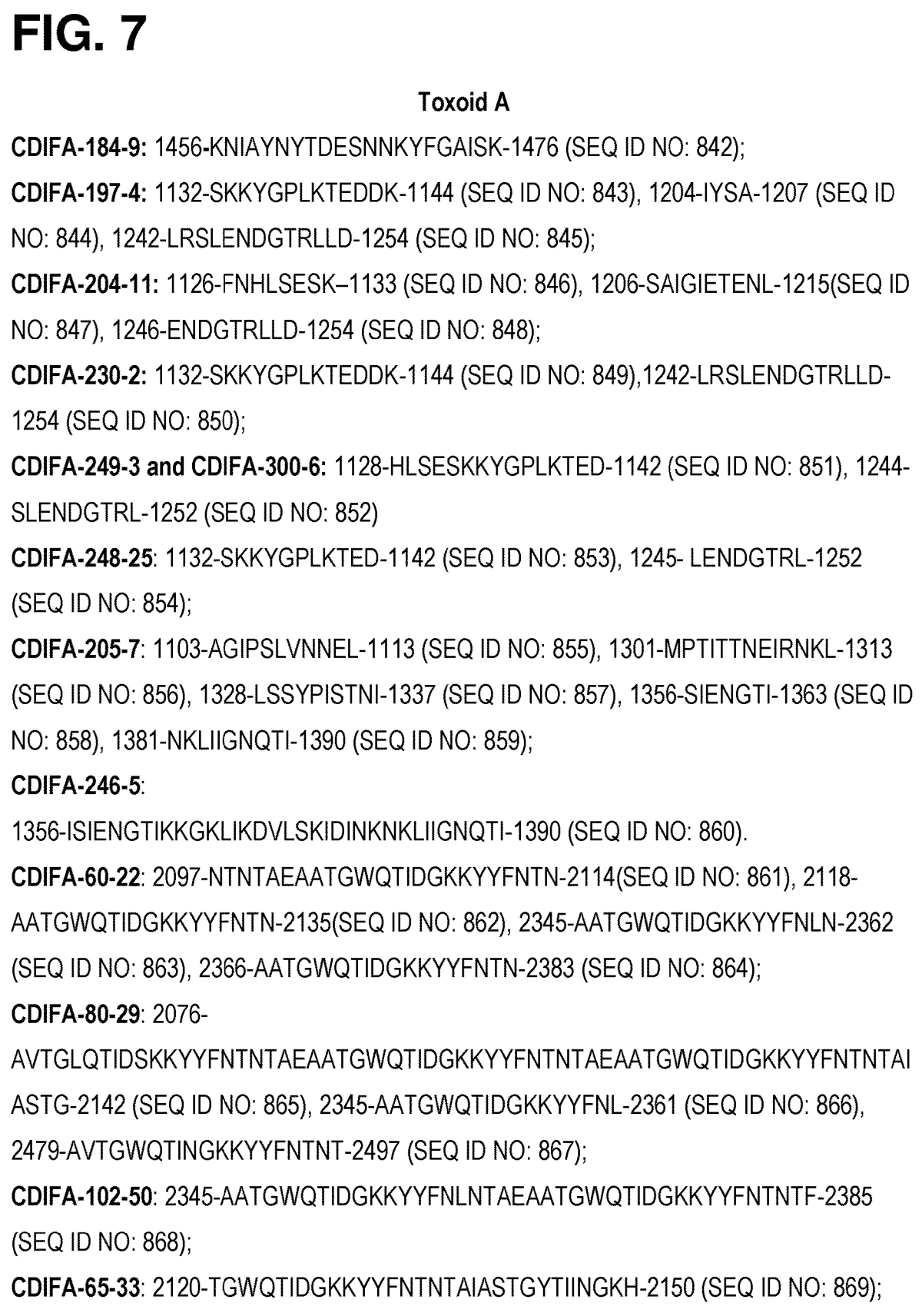

Toxoid A

CDIFA-184-9: 1456-KNIAYNYTDESNNKYFGAISK-1476 (SEQ ID NO: 842);

CDIFA-197-4: 1132-SKKYGPLKTEDDK-1144 (SEQ ID NO: 843), 1204-IYSA-1207 (SEQ ID NO: 844), 1242-LRSLENDGTRLLD-1254 (SEQ ID NO: 845);

CDIFA-204-11: 1126-FNHLSESK–1133 (SEQ ID NO: 846), 1206-SAIGIETENL-1215(SEQ ID NO: 847), 1246-ENDGTRLLD-1254 (SEQ ID NO: 848);

CDIFA-230-2: 1132-SKKYGPLKTEDDK-1144 (SEQ ID NO: 849),1242-LRSLENDGTRLLD-1254 (SEQ ID NO: 850);

CDIFA-249-3 and CDIFA-300-6: 1128-HLSESKKYGPLKTED-1142 (SEQ ID NO: 851), 1244-SLENDGTRL-1252 (SEQ ID NO: 852)

CDIFA-248-25: 1132-SKKYGPLKTED-1142 (SEQ ID NO: 853), 1245- LENDGTRL-1252 (SEQ ID NO: 854);

CDIFA-205-7: 1103-AGIPSLVNNEL-1113 (SEQ ID NO: 855), 1301-MPTITTNEIRNKL-1313 (SEQ ID NO: 856), 1328-LSSYPISTNI-1337 (SEQ ID NO: 857), 1356-SIENGTI-1363 (SEQ ID NO: 858), 1381-NKLIIGNQTI-1390 (SEQ ID NO: 859);

CDIFA-246-5:

1356-ISIENGTIKKGKLIKDVLSKIDINKNKLIIGNQTI-1390 (SEQ ID NO: 860).

CDIFA-60-22: 2097-NTNTAEAATGWQTIDGKKYYFNTN-2114(SEQ ID NO: 861), 2118-AATGWQTIDGKKYYFNTN-2135(SEQ ID NO: 862), 2345-AATGWQTIDGKKYYFNLN-2362 (SEQ ID NO: 863), 2366-AATGWQTIDGKKYYFNTN-2383 (SEQ ID NO: 864);

CDIFA-80-29: 2076-AVTGLQTIDSKKYYFNTNTAEAATGWQTIDGKKYYFNTNTAEAATGWQTIDGKKYYFNTNTAIASTG-2142 (SEQ ID NO: 865), 2345-AATGWQTIDGKKYYFNL-2361 (SEQ ID NO: 866), 2479-AVTGWQTINGKKYYFNTNT-2497 (SEQ ID NO: 867);

CDIFA-102-50: 2345-AATGWQTIDGKKYYFNLNTAEAATGWQTIDGKKYYFNTNTF-2385 (SEQ ID NO: 868);

CDIFA-65-33: 2120-TGWQTIDGKKYYFNTNTAIASTGYTIINGKH-2150 (SEQ ID NO: 869);

FIG. 7 (continued)

CDIFA-56-33: 2328-

WQTIDGKKYYFNLNTAEAATGWQTIDGKKYYFNLNTAEAATGWQTIDGKKYYFNTNTFIAST

G -2390 (SEQ ID NO: 870);

FIG. 8

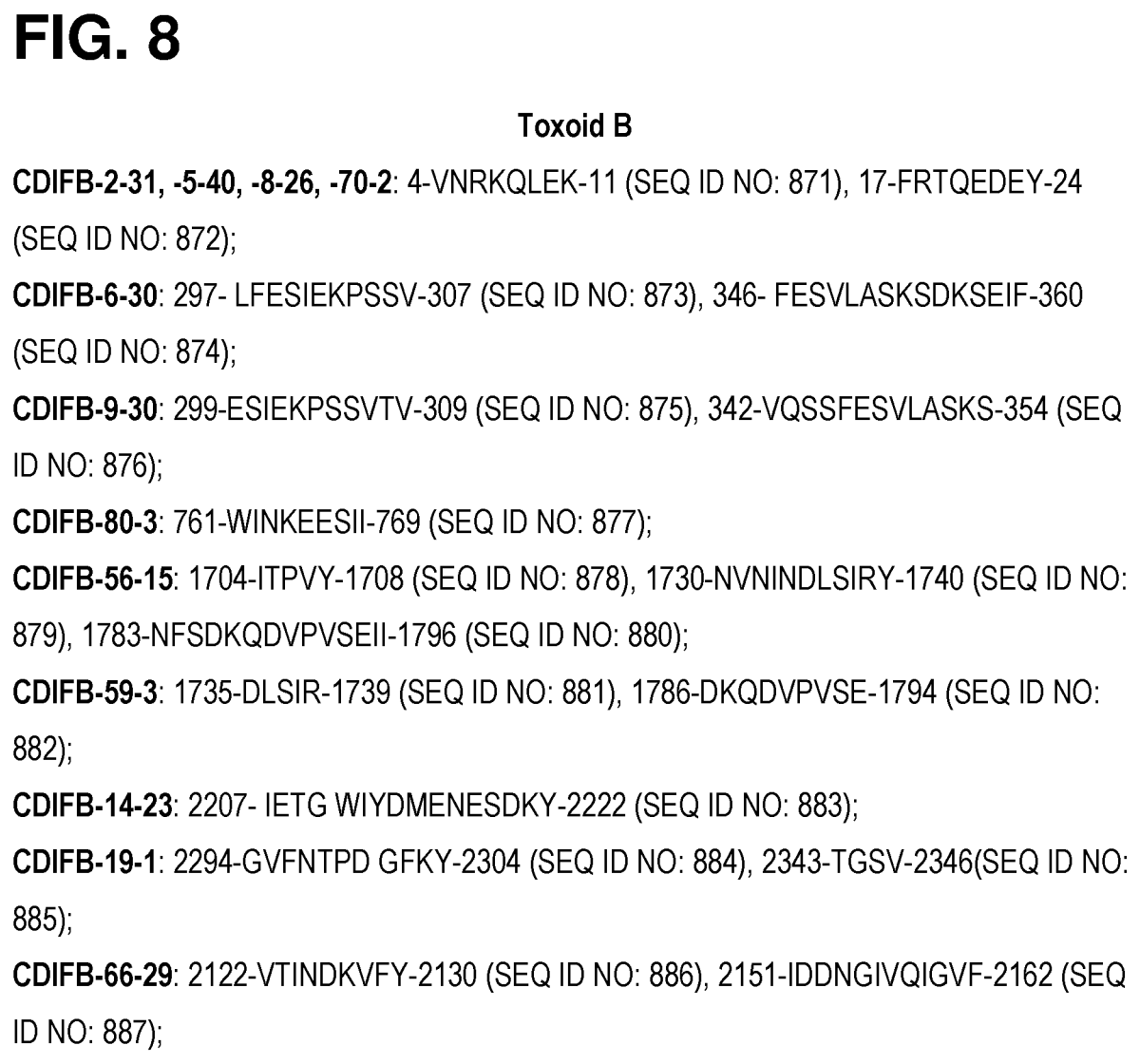

Toxoid B

CDIFB-2-31, -5-40, -8-26, -70-2: 4-VNRKQLEK-11 (SEQ ID NO: 871), 17-FRTQEDEY-24 (SEQ ID NO: 872);

CDIFB-6-30: 297- LFESIEKPSSV-307 (SEQ ID NO: 873), 346- FESVLASKSDKSEIF-360 (SEQ ID NO: 874);

CDIFB-9-30: 299-ESIEKPSSVTV-309 (SEQ ID NO: 875), 342-VQSSFESVLASKS-354 (SEQ ID NO: 876);

CDIFB-80-3: 761-WINKEESII-769 (SEQ ID NO: 877);

CDIFB-56-15: 1704-ITPVY-1708 (SEQ ID NO: 878), 1730-NVNINDLSIRY-1740 (SEQ ID NO: 879), 1783-NFSDKQDVPVSEII-1796 (SEQ ID NO: 880);

CDIFB-59-3: 1735-DLSIR-1739 (SEQ ID NO: 881), 1786-DKQDVPVSE-1794 (SEQ ID NO: 882);

CDIFB-14-23: 2207- IETG WIYDMENESDKY-2222 (SEQ ID NO: 883);

CDIFB-19-1: 2294-GVFNTPD GFKY-2304 (SEQ ID NO: 884), 2343-TGSV-2346(SEQ ID NO: 885);

CDIFB-66-29: 2122-VTINDKVFY-2130 (SEQ ID NO: 886), 2151-IDDNGIVQIGVF-2162 (SEQ ID NO: 887);

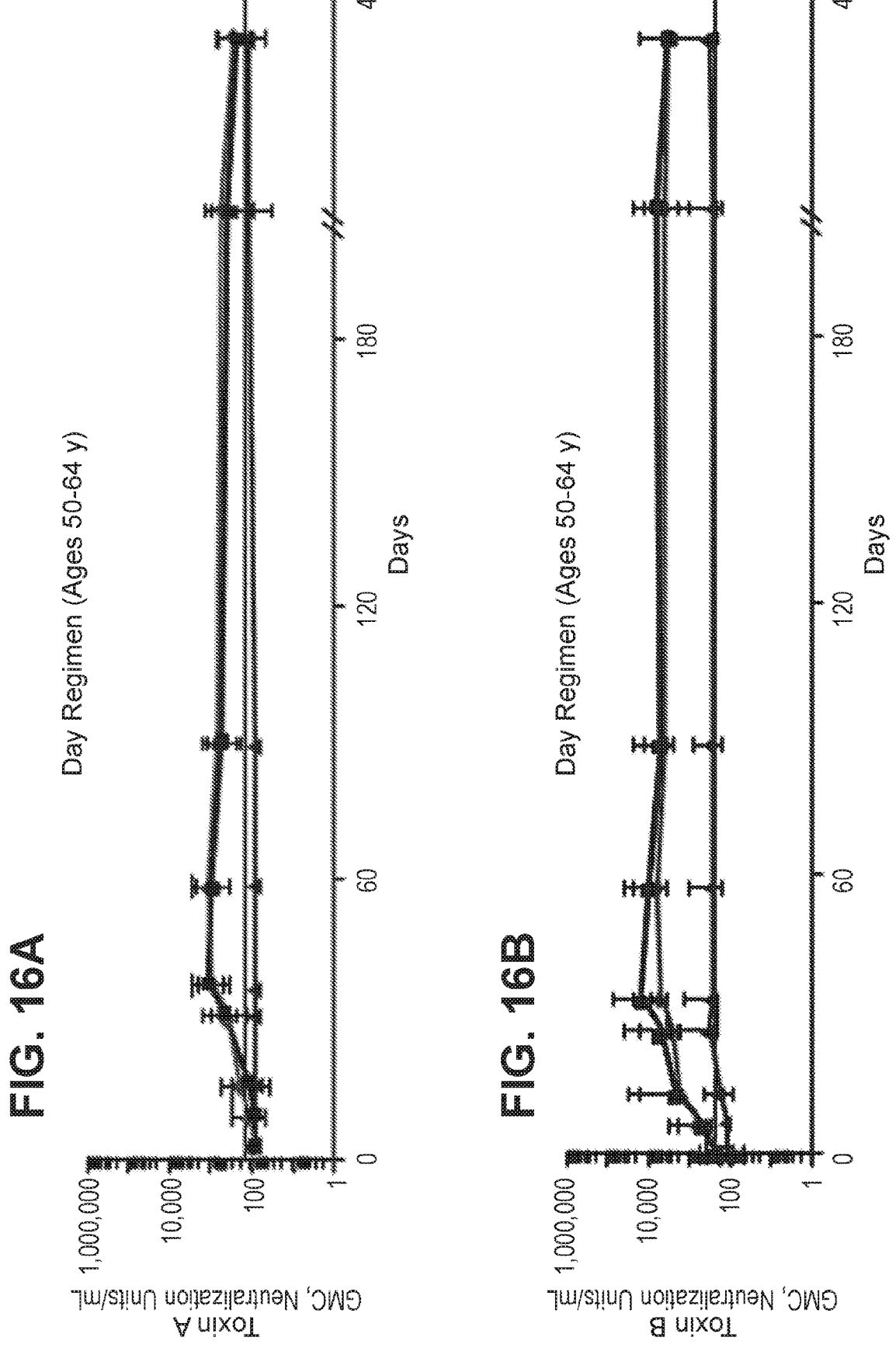

Day Regimen (Ages 65-85 y)

Day Regimen (Ages 65-85 y)

IMMUNOGENIC COMPOSITIONS AGAINST CLOSTRIDIOIDES (CLOSTRIDIUM) DIFFICILE AND METHODS THEREOF

CROSS REFERENCE TO RELATED APPLICATIONS

This application is a U.S. national phase application of International Application No. PCT/IB2021/055373, filed on Jun. 17, 2021, which claims the benefit of U.S. Provisional Application No. 63/091,277, filed on Oct. 13, 2020, U.S. Provisional Application No. 63/054,316, filed on Jul. 21, 2020, and U.S. Provisional Application No. 63/041,118, filed on Jun. 19, 2020, all of which are incorporated herein by reference in their entirety.

REFERENCE TO SEQUENCE LISTING

The instant application contains a sequence listing which has been submitted electronically in.txt format and is hereby incorporated by reference in its entirety. The .txt file, named "PC072642A_SequenceListing.txt", was created on Dec. 15, 2022 and is 11 KB in size.

FIELD

The present invention is directed to compositions and methods concerning *Clostridium difficile* toxoids and methods thereof.

BACKGROUND

*Clostridium difficile*, now *Clostridioides difficile* (*C. difficile*) is a Gram-positive anaerobic bacterium that is associated with gastrointestinal disease in humans. Colonization of *C. difficile* usually occurs in the colon if the natural gut flora is diminished by treatment with antibiotics. An infection can lead to antibiotic-associated diarrhea and sometimes pseudomembranous colitis through the secretion of the glucosylating toxins, toxin A and toxin B (approximately 308 and 270 kDa, respectively), which are the primary virulence factors of *C. difficile*.

In the last decade, the numbers and severity of *C. difficile* outbreaks in hospitals, nursing homes, and other long-term care facilities increased dramatically. Key factors in this escalation include emergence of hypervirulent pathogenic strains, increased use of antibiotics, improved detection methods, and increased exposure to airborne spores in health care facilities.

The increasing burden of *C difficile* infection (CDI) on patients and on the healthcare system demonstrates that prevention of CDI constitutes a significant unmet medical need. To date, there is no approved vaccine to prevent primary or recurrent CDI, and treatment options are non-optimal.

SUMMARY OF THE INVENTION

To meet these and other needs, the present invention relates to *C. difficile* toxoids and methods of use thereof. As used herein, each of the terms "toxoid," "mutant toxin," "genetically modified toxin," "genetically mutated toxin," "chemically modified toxin," "chemically inactivated toxin," and "genetically and chemically inactivated toxin" is considered a toxoid. In one aspect, the invention relates to a *C. difficile* vaccine currently being evaluated for efficacy and safety in subjects who are at risk for CDI. The selection of an optimal vaccination dose and regimen were based on studies, taking into consideration immunogenicity, safety, and the potential for short- and long-term protection.

In one aspect, the invention relates to an isolated polypeptide including the amino acid sequence selected from the group consisting of SEQ ID NOs: 762-840. In one embodiment, the polypeptide includes a mutation. In one embodiment, the polypeptide includes three mutations. In another embodiment, the polypeptide includes at least one amino acid side chain chemically modified by 1-ethyl-3-(3-dimethylaminopropyl) carbodiimide) (EDC). In another embodiment, the polypeptide includes at least one amino acid side chain chemically modified by N-Hydroxysuccinimide (NHS). In another embodiment, the polypeptide has an amino acid sequence that is about 60%, 65%, 70%, 75%, 80%, 85%, 86%, 87%, 88%, 89%, 90%, 91%, 92%, 93%, 94%, 95%, 96%, 97%, 98%, 99%, or 100% identical to any one of SEQ ID NOs: 762-840. In another embodiment, the polypeptide includes an epitope selected from any one of the sequences described in FIG. 7. In another embodiment, the polypeptide includes an epitope selected from any one of the sequences described in FIG. 8.

In another aspect, the invention relates to a composition including a polypeptide described herein; and a pharmaceutically acceptable diluent. In one embodiment, the composition further includes an adjuvant. In one embodiment, the composition further includes aluminum hydroxide. In one embodiment, the composition further includes a CpG oligonucleotide. In one embodiment, the composition further includes aluminum hydroxide and a CpG oligonucleotide.

In another aspect, the invention relates to an antibody or antigen binding fragment thereof including the amino acid sequence set forth in SEQ ID NO: 841. In another embodiment, the antibody or antigen binding fragment thereof has an amino acid sequence that is about 60%, 65%, 70%, 75%, 80%, 85%, 86%, 87%, 88%, 89%, 90%, 91%, 92%, 93%, 94%, 95%, 96%, 97%, 98%, 99%, or 100% identical to SEQ ID NO: 841.

In another aspect, the invention relates to a method for eliciting an immune response in a human against *Clostridium difficile* expressing a toxin including the amino acid sequence selected from the group consisting of SEQ ID NOs: 762-840, the method includes administering to the human an effective dose of a composition including a *C. difficile* toxoid. In one embodiment, the method includes administering two doses of the composition to the human. In one embodiment, the first dose and the second dose are administered about 30 days apart. In another embodiment, the first dose and the second dose are administered about 6 months apart. In one embodiment, the method includes administering three doses of the composition to the human. In one embodiment, the third dose is administered about 6 months after the first dose. In one embodiment, the human is at least 50 years of age. In one embodiment, the composition includes a *C. difficile* toxoid A and a *C. difficile* toxoid B, each having a purity of at least 90% or greater. In one embodiment, the composition includes a *C. difficile* toxoid A and a *C. difficile* toxoid B, in a ratio of about 3:1 to about 1:1. In one embodiment, the composition includes a *C. difficile* toxoid A and a *C. difficile* toxoid B, in a ratio of 1:1. In one embodiment, the composition includes an adjuvant. In one embodiment, the composition includes an aluminum adjuvant. In one embodiment, the composition includes a first polypeptide having the amino acid sequence SEQ ID NO: 4 and a second polypeptide having the amino acid sequence SEQ ID NO: 6.

BRIEF DESCRIPTION OF THE DRAWINGS

FIG. 1 sets forth amino acid sequences for 39 Toxin A variants, SEQ ID Nos: 762-800

FIG. 2 sets forth amino acid sequences for 40 Toxin B variants, SEQ ID Nos: 801-840.

FIG. 6—sets forth the amino acid sequence (SEQ ID NO: 841) for an IgG1 antibody.

FIG. 7—epitope sequences

FIG. 8—epitope sequences

FIG. 15B depicting GMC, Neutralization Units/mL against *C. difficile* Toxin B in subjects administered with QS-21 on a Shortened-Month Regimen (Ages 50-64 y); FIG. 15C depicting GMC, Neutralization Units/mL against *C. difficile* Toxin A in subjects administered with QS-21 on a Day Regimen (Ages 50-64 y); and FIG. 15D depicting GMC, Neutralization Units/mL against *C. difficile* Toxin B in subjects administered with QS-21 on a Day Regimen (Ages 50-64 y); FIG. 15E depicting GMC, Neutralization Units/mL against *C. difficile* Toxin A in subjects administered with QS-21 on a Shortened-Month Regimen (Ages 65-85 y); FIG. 15F depicting GMC, Neutralization Units/mL against *C. difficile* Toxin B in subjects administered with QS-21 on a Shortened-Month Regimen (Ages 65-85 y).

FIG. 16A-D—The toxoid-alone study had more extensive immunogenicity data available compared with the QS-21 study; a number of subjects in the toxoid-alone study received all 3 doses, and immune responses were evaluated through 12 months postdose 3. (—▲— P; —■—100 μg *C. difficile* vaccine; —◆—200 μg *C. difficile* vaccine; t indicates day vaccine was administered; —indicates lower limit of quantitation). See graphs FIG. 16A depicting GMC, Neutralization Units/mL against *C. difficile* Toxin A in subjects administered with toxoids in the absence of adjuvant on a Day Regimen (Ages 50-64 y); and FIG. 16B depicting GMC, Neutralization Units/mL against *C. difficile* Toxin B in subjects administered with toxoids in the absence of adjuvant on a Day Regimen (Ages 50-64 y); FIG. 16C depicting GMC, Neutralization Units/mL against *C. difficile* Toxin A in subjects administered with toxoids in the absence of adjuvant on a Day Regimen (Ages 65-85 y); and FIG. 16D depicting GMC, Neutralization Units/mL against *C. difficile* Toxin B in subjects administered with toxoids in the absence of adjuvant on a Day Regimen (Ages 65-85 y).

SEQUENCE IDENTIFIERS

Figure 3:
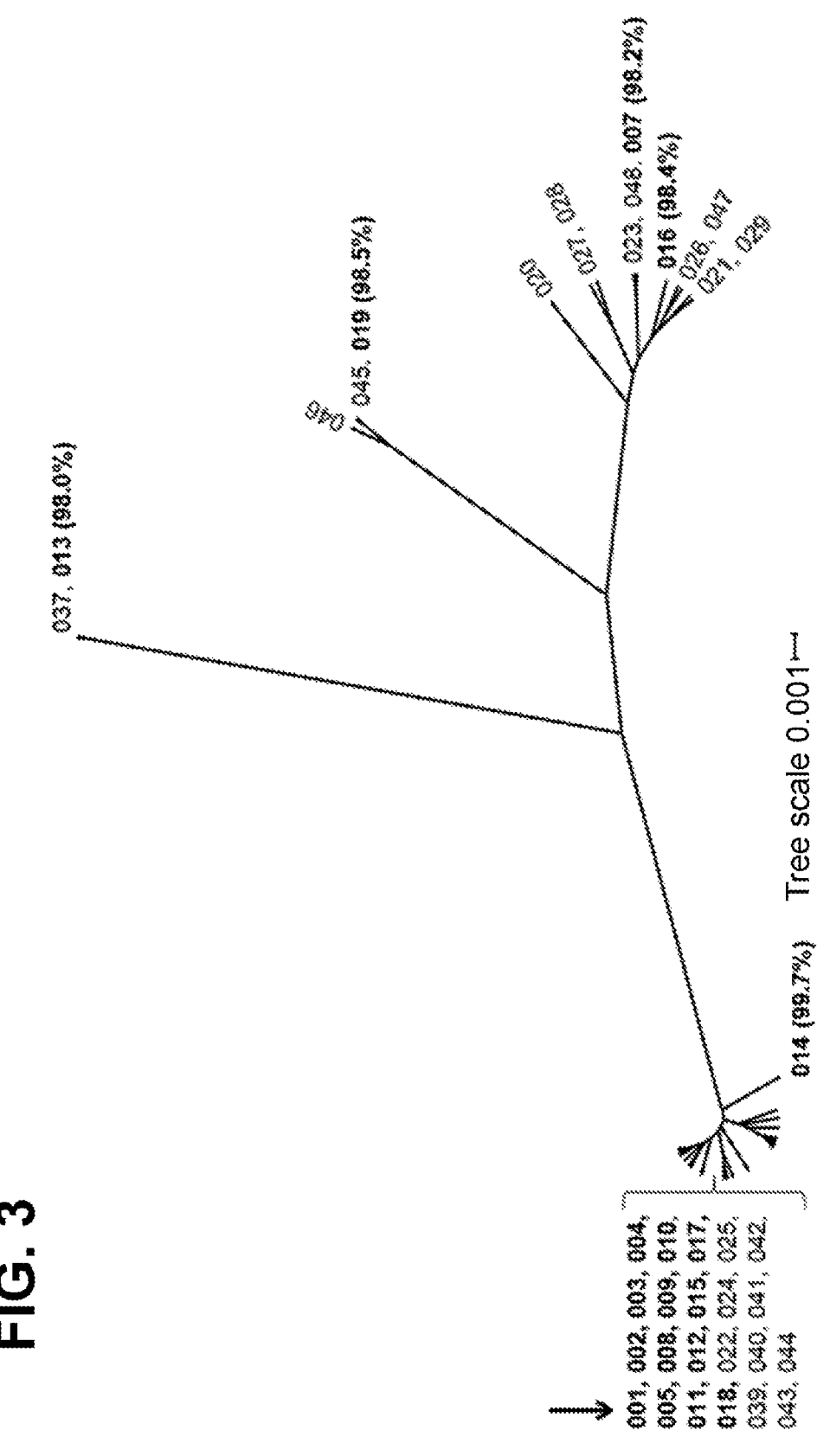
FIG. 3—Phylogenetic Diversity Among the *Clostridium difficile* Toxin A Variant Types. Phylogenetic tree illustrating the sequence similarity among the 39 TcdA protein variant types identified from whole genome sequence (WGS) of strains in a *C difficile* collection. Phylogenetic distance and amino acid sequence diversity from TcdA001 (SEQ ID NO: 762), whose sequence was used to make the vaccine antigen (SEQ ID NO: 4, wherein the methionine at position 1 is not present), is reflected by the branch length between the respective variant types and TcdA001. TcdA variant types in bold font correspond to the toxins that have been functionally tested in neutralization assays (see FIG. 5). Numbers in parenthesis adjacent to the TcdA variants in bold font correspond to the pairwise amino acid sequence identity with TcdA001. TcdA variants depicted in the non-bolded font have not yet been evaluated in neutralization assays.

SEQ ID NO: 1 sets forth the amino acid sequence for wild-type *C. difficile* 630 toxin A (TcdA).

SEQ ID NO: 2 sets forth the amino acid sequence for wild-type *C. difficile* 630 toxin B (TcdB).

SEQ ID NO: 3 sets forth the amino acid sequence for a mutant TcdA having a mutation at positions 285 and 287, as compared to SEQ ID NO: 1.

SEQ ID NO: 4 sets forth the amino acid sequence for a mutant TcdA having a mutation at positions 285, 287, and 700, as compared to SEQ ID NO: 1.

SEQ ID NO: 5 sets forth the amino acid sequence for a mutant TcdB having a mutation at positions 286 and 288, as compared to SEQ ID NO: 2.

SEQ ID NO: 6 sets forth the amino acid sequence for a mutant TcdB having a mutation at positions 286, 288, and 698, as compared to SEQ ID NO: 2.

SEQ ID NO: 7 sets forth the amino acid sequence for a mutant TcdA having a mutation at positions 269, 272, 285, 287, 460, 462, and 700, as compared to SEQ ID NO: 1

SEQ ID NO: 8 sets forth the amino acid sequence for a mutant TcdB having a mutation at positions 270, 273, 286, 288, 461, 463, and 698, as compared to SEQ ID NO: 2

SEQ ID NO: 9 sets forth a DNA sequence encoding a wild-type *C. difficile* 630 toxin A (TcdA).

SEQ ID NO: 10 sets forth a DNA sequence encoding a wild-type *C. difficile* 630 toxin B (TcdB).

SEQ ID NO: 11 sets forth a DNA sequence encoding SEQ ID NO: 3

SEQ ID NO: 12 sets forth a DNA sequence encoding SEQ ID NO: 4

SEQ ID NO: 13 sets forth a DNA sequence encoding SEQ ID NO: 5

SEQ ID NO: 14 sets forth a DNA sequence encoding SEQ ID NO: 6

SEQ ID NO: 15 sets forth the amino acid sequence for wild-type *C. difficile* R20291 TcdA.

SEQ ID NO: 16 sets forth a DNA sequence encoding SEQ ID NO: 15.

SEQ ID NO: 17 sets forth the amino acid sequence for wild-type *C. difficile* CD196 TcdA.

SEQ ID NO: 18 sets forth a DNA sequence encoding SEQ ID NO: 17.

SEQ ID NO: 19 sets forth the amino acid sequence for wild-type *C. difficile* VP110463 TcdA.

SEQ ID NO: 20 sets forth a DNA sequence encoding SEQ ID NO: 19.

SEQ ID NO: 21 sets forth the amino acid sequence for wild-type *C. difficile* R20291 TcdB.

SEQ ID NO: 22 sets forth a DNA sequence encoding SEQ ID NO: 21.

SEQ ID NO: 23 sets forth the amino acid sequence for wild-type *C. difficile* CD196 TcdB.

SEQ ID NO: 24 sets forth a DNA sequence encoding SEQ ID NO: 23.

SEQ ID NO: 25 sets forth the amino acid sequence for wild-type *C. difficile* VP110463 TcdB.

SEQ ID NO: 26 sets forth a DNA sequence encoding SEQ ID NO: 25.

SEQ ID NO: 27 sets forth a DNA sequence of a pathogenicity locus of wild-type *C. difficile* VP110463.

SEQ ID NO: 28 sets forth the amino acid sequence for residues 101 to 293 of SEQ ID NO: 1.

SEQ ID NO: 29 sets forth the amino acid sequence for residues 1 to 542 of SEQ ID NO: 1.

SEQ ID NO: 30 sets forth the amino acid sequence for residues 101 to 293 of SEQ ID NO: 2.

SEQ ID NO: 31 sets forth the amino acid sequence for residues 1 to 543 of SEQ ID NO: 2.

SEQ ID NO: 32 sets forth the amino acid sequence for residues 543 to 809 of SEQ ID NO: 1.

SEQ ID NO: 33 sets forth the amino acid sequence for residues 544 to 767 of SEQ ID NO: 2.

SEQ ID NO: 34 sets forth the amino acid sequence for a mutant TcdA, wherein residues 101, 269, 272, 285, 287, 460, 462, 541, 542, 543, 589, 655, and 700 may be any amino acid.

SEQ ID NO: 35 sets forth the amino acid sequence for a mutant TcdB, wherein 102, 270, 273, 286, 288, 384, 461, 463, 520, 543, 544, 587, 600, 653, 698, and 751 may be any amino acid.

SEQ ID NO: 36 sets forth the amino acid sequence for the variable light chain of a neutralizing antibody of *C. difficile* TcdA (A3-25 mAb).

SEQ ID NO: 37 sets forth the amino acid sequence for the variable heavy chain of a neutralizing antibody of *C. difficile* TcdA (A3-25 mAb).

SEQ ID NO: 38 sets forth the amino acid sequence for CDR1 of the variable light chain of neutralizing antibody of *C. difficile* TcdA (A3-25 mAb).

SEQ ID NO: 39 sets forth the amino acid sequence for CDR2 of the variable light chain of neutralizing antibody of *C. difficile* TcdA (A3-25 mAb).

SEQ ID NO: 40 sets forth the amino acid sequence for CDR3 of the variable light chain of neutralizing antibody of *C. difficile* TcdA (A3-25 mAb).

SEQ ID NO: 41 sets forth the amino acid sequence for CDR1 of the variable heavy chain of neutralizing antibody of *C. difficile* TcdA (A3-25 mAb).

SEQ ID NO: 42 sets forth the amino acid sequence for CDR2 of the variable heavy chain of neutralizing antibody of *C. difficile* TcdA (A3-25 mAb).

SEQ ID NO: 43 sets forth the amino acid sequence for CDR3 of the variable heavy chain of neutralizing antibody of *C. difficile* TcdA (A3-25 mAb).

SEQ ID NO: 44 sets forth a DNA sequence encoding SEQ ID NO: 3.

SEQ ID NO: 45 sets forth a DNA sequence encoding SEQ ID NO: 4.

SEQ ID NO: 46 sets forth a DNA sequence encoding SEQ ID NO: 5.

SEQ ID NO: 47 sets forth a DNA sequence encoding SEQ ID NO: 6.

SEQ ID NO: 48 sets forth the nucleotide sequence of immunostimulatory oligonucleotide ODN CpG 24555.

SEQ ID NO: 49 sets forth the amino acid sequence for the variable heavy chain of a *C. difficile* TcdB neutralizing antibody (B8-26 mAb).

SEQ ID NO: 50 sets forth the amino acid sequence for the signal peptide of the variable heavy chain of a *C. difficile* TcdB neutralizing antibody (B8-26 mAb).

SEQ ID NO: 51 sets forth the amino acid sequence for CDR1 of the variable heavy chain of a *C. difficile* TcdB neutralizing antibody (B8-26 mAb).

SEQ ID NO: 52 sets forth the amino acid sequence for CDR2 of the variable heavy chain of a *C. difficile* TcdB neutralizing antibody (B8-26 mAb).

SEQ ID NO: 53 sets forth the amino acid sequence for CDR3 of the variable heavy chain of a *C. difficile* TcdB neutralizing antibody (B8-26 mAb).

SEQ ID NO: 54 sets forth the amino acid sequence for the constant region of the variable heavy chain of a *C. difficile* TcdB neutralizing antibody (B8-26 mAb).

SEQ ID NO: 55 sets forth the amino acid sequence for the variable light chain of a *C. difficile* TcdB neutralizing antibody (B8-26 mAb).

SEQ ID NO: 56 sets forth the amino acid sequence for the signal peptide of the variable light chain of a *C. difficile* TcdB neutralizing antibody (B8-26 mAb).

SEQ ID NO: 57 sets forth the amino acid sequence for CDR1 of the variable light chain of a *C. difficile* TcdB neutralizing antibody (B8-26 mAb).

SEQ ID NO: 58 sets forth the amino acid sequence for CDR2 of the variable light chain of a *C. difficile* TcdB neutralizing antibody (B8-26 mAb).

SEQ ID NO: 59 sets forth the amino acid sequence for CDR3 of the variable light chain of a *C. difficile* TcdB neutralizing antibody (B8-26 mAb).

SEQ ID NO: 60 sets forth the amino acid sequence for the variable heavy chain of a *C. difficile* TcdB neutralizing antibody (B59-3 mAb).

SEQ ID NO: 61 sets forth the amino acid sequence for the signal peptide of the variable heavy chain of a *C. difficile* TcdB neutralizing antibody (B59-3 mAb).

SEQ ID NO: 62 sets forth the amino acid sequence for CDR1 of the variable heavy chain of a *C. difficile* TcdB neutralizing antibody (B59-3 mAb).

SEQ ID NO: 63 sets forth the amino acid sequence for CDR2 of the variable heavy chain of a *C. difficile* TcdB neutralizing antibody (B59-3 mAb).

SEQ ID NO: 64 sets forth the amino acid sequence for CDR3 of the variable heavy chain of a *C. difficile* TcdB neutralizing antibody (B59-3 mAb).

SEQ ID NO: 65 sets forth the amino acid sequence for the constant region of the variable heavy chain of a *C. difficile* TcdB neutralizing antibody (B59-3 mAb).

SEQ ID NO: 66 sets forth the amino acid sequence for the variable light chain of a *C. difficile* TcdB neutralizing antibody (B59-3 mAb).

SEQ ID NO: 67 sets forth the amino acid sequence for the signal peptide of the variable light chain of a *C. difficile* TcdB neutralizing antibody (B59-3 mAb).

SEQ ID NO: 68 sets forth the amino acid sequence for CDR1 of the variable light chain of a *C. difficile* TcdB neutralizing antibody (B59-3 mAb).

SEQ ID NO: 69 sets forth the amino acid sequence for CDR2 of the variable light chain of a *C. difficile* TcdB neutralizing antibody (B59-3 mAb).

SEQ ID NO: 70 sets forth the amino acid sequence for CDR3 of the variable light chain of a *C. difficile* TcdB neutralizing antibody (B59-3 mAb).

SEQ ID NO: 71 sets forth the amino acid sequence for the variable heavy chain of a *C. difficile* TcdB neutralizing antibody (B9-30 mAb).

SEQ ID NO: 72 sets forth the amino acid sequence for the signal peptide of the variable heavy chain of a *C. difficile* TcdB neutralizing antibody (B9-30 mAb).

SEQ ID NO: 73 sets forth the amino acid sequence for CDR1 of the variable heavy chain of a *C. difficile* TcdB neutralizing antibody (B9-30 mAb).

SEQ ID NO: 74 sets forth the amino acid sequence for CDR2 of the variable heavy chain of a *C. difficile* TcdB neutralizing antibody (B9-30 mAb).

SEQ ID NO: 75 sets forth the amino acid sequence for CDR3 of the variable heavy chain of a *C. difficile* TcdB neutralizing antibody (B9-30 mAb).

SEQ ID NO: 76 sets forth the amino acid sequence for the constant region of the variable heavy chain of a *C. difficile* TcdB neutralizing antibody (B9-30 mAb).

SEQ ID NO: 77 sets forth the amino acid sequence for the variable light chain of a *C. difficile* TcdB neutralizing antibody (B9-30 mAb).

SEQ ID NO: 78 sets forth the amino acid sequence for the signal peptide of the variable light chain of a *C. difficile* TcdB neutralizing antibody (B9-30 mAb).

SEQ ID NO: 79 sets forth the amino acid sequence for CDR1 of the variable light chain of a *C. difficile* TcdB neutralizing antibody (B9-30 mAb).

SEQ ID NO: 80 sets forth the amino acid sequence for CDR2 of the variable light chain of a *C. difficile* TcdB neutralizing antibody (B9-30 mAb).

SEQ ID NO: 81 sets forth the amino acid sequence for CDR3 of the variable light chain of a *C. difficile* TcdB neutralizing antibody (B9-30 mAb).

SEQ ID NO: 82 sets forth the amino acid sequence for a mutant TcdB, wherein a residue at positions 102, 270, 273, 286, 288, 384, 461, 463, 520, 543, 544, 587, 600, 653, 698, and 751 may be any amino acid.

SEQ ID NO: 83 sets forth the amino acid sequence for a mutant TcdA having a mutation at positions 269, 272, 285, 287, 460, 462, and 700, as compared to SEQ ID NO: 1, wherein the methionine at position 1 is absent.

SEQ ID NO: 84 sets forth the amino acid sequence for a mutant *C. difficile* toxin A having a mutation at positions 285, 287, and 700, as compared to SEQ ID NO: 1, wherein the methionine at position 1 is absent.

SEQ ID NO: 85 sets forth the amino acid sequence for a mutant *C. difficile* toxin B having a mutation at positions 270, 273, 286, 288, 461, 463, and 698, as compared to SEQ ID NO: 2, wherein the methionine at position 1 is absent.

SEQ ID NO: 86 sets forth the amino acid sequence for a mutant *C. difficile* toxin B having a mutation at positions 286, 288, and 698, as compared to SEQ ID NO: 2, wherein the methionine at position 1 is absent.

SEQ ID NO: 87 sets forth the amino acid sequence for wild-type *C. difficile* 2004013 TcdA.

SEQ ID NO: 88 sets forth the amino acid sequence for wild-type *C. difficile* 2004111 TcdA.

SEQ ID NO: 89 sets forth the amino acid sequence for wild-type *C. difficile* 2004118 TcdA.

SEQ ID NO: 90 sets forth the amino acid sequence for wild-type *C. difficile* 2004205 TcdA.

SEQ ID NO: 91 sets forth the amino acid sequence for wild-type *C. difficile* 2004206 TcdA.

SEQ ID NO: 92 sets forth the amino acid sequence for wild-type *C. difficile* 2005022 TcdA.

SEQ ID NO: 93 sets forth the amino acid sequence for wild-type *C. difficile* 2005088 TcdA.

SEQ ID NO: 94 sets forth the amino acid sequence for wild-type *C. difficile* 2005283 TcdA.

SEQ ID NO: 95 sets forth the amino acid sequence for wild-type *C. difficile* 2005325 TcdA.

SEQ ID NO: 96 sets forth the amino acid sequence for wild-type *C. difficile* 2005359 TcdA.

SEQ ID NO: 97 sets forth the amino acid sequence for wild-type *C. difficile* 2006017 TcdA.

SEQ ID NO: 98 sets forth the amino acid sequence for wild-type *C. difficile* 2007070 TcdA.

SEQ ID NO: 99 sets forth the amino acid sequence for wild-type *C. difficile* 2007217 TcdA.

SEQ ID NO: 100 sets forth the amino acid sequence for wild-type *C. difficile* 2007302 TcdA.

SEQ ID NO: 101 sets forth the amino acid sequence for wild-type *C. difficile* 2007816 TcdA.

SEQ ID NO: 102 sets forth the amino acid sequence for wild-type *C. difficile* 2007838 TcdA.

SEQ ID NO: 103 sets forth the amino acid sequence for wild-type *C. difficile* 2007858 TcdA.

SEQ ID NO: 104 sets forth the amino acid sequence for wild-type *C. difficile* 2007886 TcdA.

SEQ ID NO: 105 sets forth the amino acid sequence for wild-type *C. difficile* 2008222 TcdA.

SEQ ID NO: 106 sets forth the amino acid sequence for wild-type *C. difficile* 2009078 TcdA.

SEQ ID NO: 107 sets forth the amino acid sequence for wild-type *C. difficile* 2009087 TcdA.

SEQ ID NO: 108 sets forth the amino acid sequence for wild-type *C. difficile* 2009141 TcdA.

SEQ ID NO: 109 sets forth the amino acid sequence for wild-type *C. difficile* 2009292 TcdA.

SEQ ID NO: 110 sets forth the amino acid sequence for wild-type *C. difficile* 2004013 TcdB.

SEQ ID NO: 111 sets forth the amino acid sequence for wild-type *C. difficile* 2004111 TcdB.

SEQ ID NO: 112 sets forth the amino acid sequence for wild-type *C. difficile* 2004118 TcdB.

SEQ ID NO: 113 sets forth the amino acid sequence for wild-type *C. difficile* 2004205 TcdB.

SEQ ID NO: 114 sets forth the amino acid sequence for wild-type *C. difficile* 2004206 TcdB.

SEQ ID NO: 115 sets forth the amino acid sequence for wild-type *C. difficile* 2005022 TcdB.

SEQ ID NO: 116 sets forth the amino acid sequence for wild-type *C. difficile* 2005088 TcdB.

SEQ ID NO: 117 sets forth the amino acid sequence for wild-type *C. difficile* 2005283 TcdB.

SEQ ID NO: 118 sets forth the amino acid sequence for wild-type *C. difficile* 2005325 TcdB.

SEQ ID NO: 119 sets forth the amino acid sequence for wild-type *C. difficile* 2005359 TcdB.

SEQ ID NO: 120 sets forth the amino acid sequence for wild-type *C. difficile* 2006017 TcdB.

SEQ ID NO: 121 sets forth the amino acid sequence for wild-type *C. difficile* 2006376 TcdB.

SEQ ID NO: 122 sets forth the amino acid sequence for wild-type *C. difficile* 2007070 TcdB.

SEQ ID NO: 123 sets forth the amino acid sequence for wild-type *C. difficile* 2007217 TcdB.

SEQ ID NO: 124 sets forth the amino acid sequence for wild-type *C. difficile* 2007302 TcdB.

SEQ ID NO: 125 sets forth the amino acid sequence for wild-type *C. difficile* 2007816 TcdB.

SEQ ID NO: 126 sets forth the amino acid sequence for wild-type *C. difficile* 2007838 TcdB.

SEQ ID NO: 127 sets forth the amino acid sequence for wild-type *C. difficile* 2007858 TcdB.

SEQ ID NO: 128 sets forth the amino acid sequence for wild-type *C. difficile* 2007886 TcdB.

SEQ ID NO: 129 sets forth the amino acid sequence for wild-type *C. difficile* 2008222 TcdB.

SEQ ID NO: 130 sets forth the amino acid sequence for wild-type *C. difficile* 2009078 TcdB.

SEQ ID NO: 131 sets forth the amino acid sequence for wild-type *C. difficile* 2009087 TcdB.

SEQ ID NO: 132 sets forth the amino acid sequence for wild-type *C. difficile* 2009141 TcdB.

SEQ ID NO: 133 sets forth the amino acid sequence for wild-type *C. difficile* 2009292 TcdB.

SEQ ID NO: 134 sets forth the amino acid sequence for wild-type *C. difficile* 014 TcdA.

SEQ ID NO: 135 sets forth the amino acid sequence for wild-type *C. difficile* 015 TcdA.

SEQ ID NO: 136 sets forth the amino acid sequence for wild-type *C. difficile* 020 TcdA.

SEQ ID NO: 137 sets forth the amino acid sequence for wild-type *C. difficile* 023 TcdA.

SEQ ID NO: 138 sets forth the amino acid sequence for wild-type *C. difficile* 027 TcdA.

SEQ ID NO: 139 sets forth the amino acid sequence for wild-type *C. difficile* 029 TcdA.

SEQ ID NO: 140 sets forth the amino acid sequence for wild-type *C. difficile* 046 TcdA.

SEQ ID NO: 141 sets forth the amino acid sequence for wild-type *C. difficile* 014 TcdB.

SEQ ID NO: 142 sets forth the amino acid sequence for wild-type *C. difficile* 015 TcdB.

SEQ ID NO: 143 sets forth the amino acid sequence for wild-type *C. difficile* 020 TcdB.

SEQ ID NO: 144 sets forth the amino acid sequence for wild-type *C. difficile* 023 TcdB.

SEQ ID NO: 145 sets forth the amino acid sequence for wild-type *C. difficile* 027 TcdB.

SEQ ID NO: 146 sets forth the amino acid sequence for wild-type *C. difficile* 029 TcdB.

SEQ ID NO: 147 sets forth the amino acid sequence for wild-type *C. difficile* 046 TcdB.

SEQ ID NO: 148 sets forth the amino acid sequence for wild-type *C. difficile* 001 TcdA.

SEQ ID NO: 149 sets forth the amino acid sequence for wild-type *C. difficile* 002 TcdA.

SEQ ID NO: 150 sets forth the amino acid sequence for wild-type *C. difficile* 003 TcdA.

SEQ ID NO: 151 sets forth the amino acid sequence for wild-type *C. difficile* 004 TcdA.

SEQ ID NO: 152 sets forth the amino acid sequence for wild-type *C. difficile* 070 TcdA.

SEQ ID NO: 153 sets forth the amino acid sequence for wild-type *C. difficile* 075 TcdA.

SEQ ID NO: 154 sets forth the amino acid sequence for wild-type *C. difficile* 077 TcdA.

SEQ ID NO: 155 sets forth the amino acid sequence for wild-type *C. difficile* 081 TcdA.

SEQ ID NO: 156 sets forth the amino acid sequence for wild-type *C. difficile* 117 TcdA.

SEQ ID NO: 157 sets forth the amino acid sequence for wild-type *C. difficile* 131 TcdA.

SEQ ID NO: 158 sets forth the amino acid sequence for wild-type *C. difficile* 001 TcdB.

SEQ ID NO: 159 sets forth the amino acid sequence for wild-type *C. difficile* 002 TcdB.

SEQ ID NO: 160 sets forth the amino acid sequence for wild-type *C. difficile* 003 TcdB.

SEQ ID NO: 161 sets forth the amino acid sequence for wild-type *C. difficile* 004 TcdB.

SEQ ID NO: 162 sets forth the amino acid sequence for wild-type *C. difficile* 070 TcdB.

SEQ ID NO: 163 sets forth the amino acid sequence for wild-type *C. difficile* 075 TcdB.

SEQ ID NO: 164 sets forth the amino acid sequence for wild-type *C. difficile* 077 TcdB.

SEQ ID NO: 165 sets forth the amino acid sequence for wild-type *C. difficile* 081 TcdB.

SEQ ID NO: 166 sets forth the amino acid sequence for wild-type *C. difficile* 117 TcdB.

SEQ ID NO: 167 sets forth the amino acid sequence for wild-type *C. difficile* 131 TcdB.

SEQ ID NO: 168 sets forth the amino acid sequence for wild-type *C. difficile* 053 TcdA.

SEQ ID NO: 169 sets forth the amino acid sequence for wild-type *C. difficile* 078 TcdA.

SEQ ID NO: 170 sets forth the amino acid sequence for wild-type *C. difficile* 087 TcdA.

SEQ ID NO: 171 sets forth the amino acid sequence for wild-type *C. difficile* 095 TcdA.

SEQ ID NO: 172 sets forth the amino acid sequence for wild-type *C. difficile* 126 TcdA.

SEQ ID NO: 173 sets forth the amino acid sequence for wild-type *C. difficile* 053 TcdB.

SEQ ID NO: 174 sets forth the amino acid sequence for wild-type *C. difficile* 078 TcdB.

SEQ ID NO: 175 sets forth the amino acid sequence for wild-type *C. difficile* 087 TcdB.

SEQ ID NO: 176 sets forth the amino acid sequence for wild-type *C. difficile* 095 TcdB.

SEQ ID NO: 177 sets forth the amino acid sequence for wild-type *C. difficile* 126 TcdB.

SEQ ID NO: 178 sets forth the amino acid sequence for wild-type *C. difficile* 059 TcdA.

SEQ ID NO: 179 sets forth the amino acid sequence for wild-type *C. difficile* 059 TcdB.

SEQ ID NO: 180 sets forth the amino acid sequence for wild-type *C. difficile* 106 TcdA.

SEQ ID NO: 181 sets forth the amino acid sequence for wild-type *C. difficile* 106 TcdB.

SEQ ID NO: 182 sets forth the amino acid sequence for wild-type *C. difficile* 017 TcdB.

SEQ ID NO: 183 sets forth the amino acid sequence for a mutant TcdA having a mutation at positions 285, 287, 700, 972, and 978 as compared to SEQ ID NO: 1.

SEQ ID NO: 184 sets forth the amino acid sequence for a mutant TcdB having a mutation at positions 286, 288, 698, 970, and 976 as compared to SEQ ID NO: 2.

SEQ ID NO: 185 through SEQ ID NO: 195 each set forth the amino acid sequence for an exemplary mutant toxin.

SEQ ID NO: 196 through SEQ ID NO: 212 each set forth the amino acid sequence for an exemplary mutant toxin A.

SEQ ID NO: 213 through SEQ ID NO: 222 each set forth the amino acid sequence for an exemplary mutant toxin B.

SEQ ID NO: 223 through SEQ ID NO: 236 each set forth the amino acid sequence for an exemplary mutant toxin A.

SEQ ID NO: 237 through SEQ ID NO: 243 each set forth the amino acid sequence for an exemplary mutant toxin B.

SEQ ID NO: 244 through SEQ ID NO: 245 each set forth the amino acid sequence for an exemplary mutant toxin A.

SEQ ID NO: 246 through SEQ ID NO: 249 each set forth the amino acid sequence for an exemplary mutant toxin B.

SEQ ID NO: 250 through SEQ ID NO: 253 each set forth the amino acid sequence for an exemplary mutant toxin A.

SEQ ID NO: 254 sets forth the amino acid sequence for an exemplary mutant toxin.

SEQ ID NO: 255 through SEQ ID NO: 263 each set forth the amino acid sequence for an exemplary mutant toxin A.

SEQ ID NO: 264 through SEQ ID NO: 269 each set forth the amino acid sequence for an exemplary mutant toxin B.

SEQ ID NO: 270 through SEQ ID NO: 275 each set forth the amino acid sequence for an exemplary mutant toxin.

SEQ ID NO: 276 through SEQ ID NO: 323 each set forth the amino acid sequence for an exemplary mutant toxin A.

SEQ ID NO: 324 through SEQ ID NO: 373 each set forth the amino acid sequence for an exemplary mutant toxin B.

SEQ ID NO: 374 through SEQ ID NO: 421 each set forth the amino acid sequence for an exemplary mutant toxin A.

SEQ ID NO: 422 through SEQ ID NO: 471 each set forth the amino acid sequence for an exemplary mutant toxin B.

SEQ ID NO: 472 through SEQ ID NO: 519 each set forth the amino acid sequence for an exemplary mutant toxin A.

SEQ ID NO: 568 through SEQ ID NO: 615 each set forth the amino acid sequence for an exemplary mutant toxin B.

SEQ ID NO: 520 through SEQ ID NO: 567 each set forth the amino acid sequence for an exemplary mutant toxin A.

SEQ ID NO: 616 through SEQ ID NO: 663 each set forth the amino acid sequence for an exemplary mutant toxin B.

SEQ ID NO: 664 through SEQ ID NO: 711 each set forth the amino acid sequence for an exemplary mutant toxin A.

SEQ ID NO: 712 through SEQ ID NO: 761 each set forth the amino acid sequence for an exemplary mutant toxin B.

SEQ ID NO: 762 through SEQ ID NO: 800 each set forth the amino acid sequence for a toxin A variant. See FIG. 1.

SEQ ID NO: 801 through SEQ ID NO: 840 each set forth the amino acid sequence for a toxin B variant. See FIG. 2.

SEQ ID NO: 841 sets forth the amino acid sequence for an IgG1 antibody.

SEQ ID NO: 842—SEQ ID NO: 870 sets forth the amino acid sequence for an epitope. (see FIG. 7)

SEQ ID NO: 871—SEQ ID NO: 887) sets forth the amino acid sequence for an epitope. (see FIG. 8)

SEQ ID Nos: 1-887 are identical to the respective SEQ ID Nos: 1-887 from WO2020201985 (PCT/1132020/053005), filed on Mar. 30, 2020, which is incorporated by reference in its entirety.

SEQ ID NO: 888-1015 each set forth the amino acid sequence for an exemplary monoclonal antibody region.

SEQ ID NO: 1016-1090 each set forth the amino acid sequence for an exemplary epitope related to toxin A.

DETAILED DESCRIPTION OF THE INVENTION

The inventors determined the bacterial genome sequences of >500 *C. difficile* disease-causing isolates and analyzed sequences coding for the respective toxins in these isolates. Surprisingly, 39 unique TcdA (FIG. 1) and 40 unique TcdB (FIG. 2) protein variants were identified. The inventors further discovered that PCR-ribotyping is not a strain typing tool that is predictive of the toxin variant diversity associated with *C. difficile* disease-causing isolates.

In one aspect, the invention relates to compositions and methods that may be used to treat, ameliorate, reduce the risk of, and/or prevent infection by *C. difficile*, comprising a polypeptide that comprises a sequence selected from the group consisting of SEQ ID Nos: 762-800. In another aspect, the invention relates to compositions and methods that may be used to treat, ameliorate, reduce the risk of, and/or prevent infection by *C. difficile*, comprising a polypeptide that comprises a sequence selected from the group consisting of SEQ ID Nos: 801-840. In one embodiment, the polypeptide comprises a mutation to produce a toxoid, as described below. In another embodiment, the polypeptide is inactivated by chemical treatment, as described below, to produce a toxoid. In yet another embodiment, the polypeptide comprises a mutation and is inactivated by chemical treatment.

Figure 7:
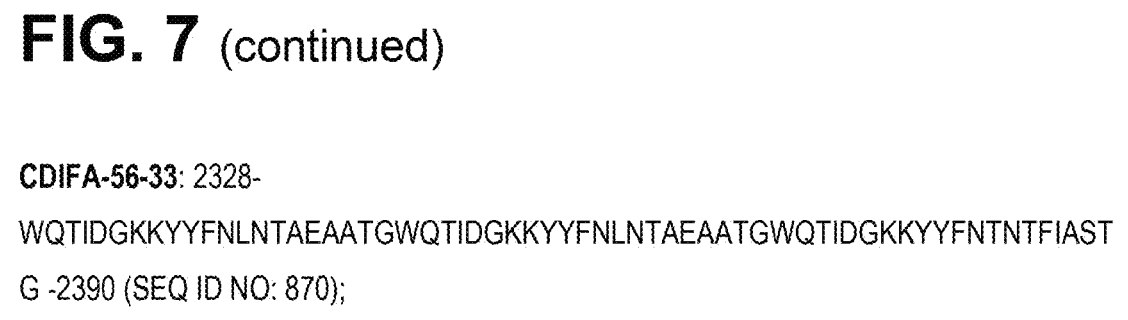

In a preferred embodiment, the toxoid A includes any one of the epitopes described in FIG. 7. In a preferred embodiment, the toxoid B includes any one of the epitopes described in FIG. 8.

Figure 11:
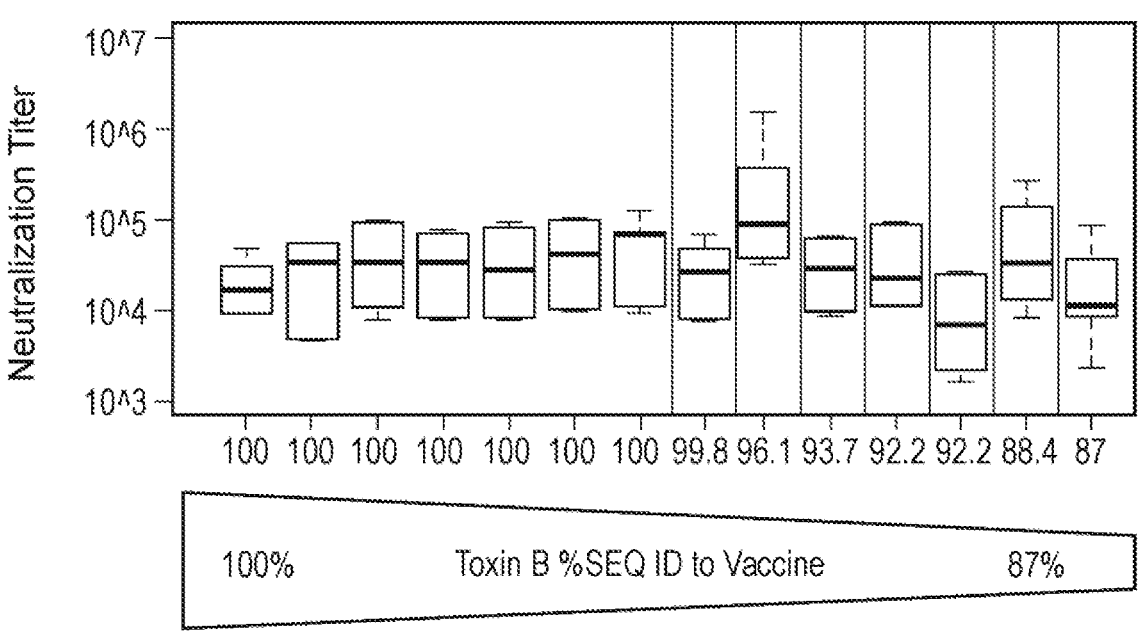
FIG. 11—Vaccine induces antibodies that neutralize toxins A and B regardless of their sequence diversity FIG. 12A-B—From the deduced amino acid sequence of TcdA variants, an unrooted phylogenetic tree was constructed using the unweighted pair group method with arithmetic mean (UPGMA) (FIG. 12A). Of the 36 variants that differed from TcdB001, pairwise amino acid sequence identity with TcdB001 ranged from 86.1% to >99.9%. This is illustrated in the phylogenetic tree of TcdB variants (FIG. 12B).

In another aspect, the invention relates to the discovery that a composition comprising a *C. difficile* toxoid A and a *C. difficile* toxoid B (derived from strain 630) elicited antibodies that are capable of binding to a corresponding toxin produced by different strains of *C. difficile*. See, for example, FIG. 11 and FIG. 14. Surprisingly, the composition elicited an antibody that neutralizes the cytotoxic activity of a toxin (e.g., toxin B) having less than 90% amino acid sequence identity to the wild-type toxin from strain 630. More specifically, toxin B variant TcdB011 (SEQ ID NO: 811) has about 87% amino acid sequence identity with TcdB001 (SEQ ID NO: 801), and yet polyclonal human immune sera from a human who received a dose of a composition comprising a toxoid A and a toxoid B effectively neutralized the cytotoxic activity of variant TcdB011 (SEQ ID NO: 811). See Example 4 and FIG. 5. Accordingly, the composition comprising toxoids elicited "cross-reactive" antibodies and binding fragments thereof. "Cross-reactivity" as used herein refers to the ability to react with similar antigenic sites on toxin variants having a sequence that is less than 100% identical to the toxin sequence from which the toxoid antigen was derived. In one embodiment, the antibody elicited by the composition has the ability to react with a corresponding antigenic site on a toxin variant having a sequence identity that is less than 99.9%, 99.8%, 99.7%, 99.6%, 99.5%, 99.4%, 99.3%, 99.2%, 99.1%, 99%, 98.9%, 98.8%, 98.7%, 98.6%, 98.5%, 98.4%, 98.3%, 98.2%, 98.1%, 98%, 97.9%, 97.8%, 97.7%, 97.6%, 97.5%, 97.4%, 97.3%, 97.2%, 97.1%, 97%, 96%, 95%, 94%, 93%, 92%, 91%, 90%, 89%, 88%, 87%, 86%, or 85% identical to the toxin sequence from which the toxoid antigen was derived.

For example, in one embodiment, cross-reactivity refers to the ability to react with similar antigenic sites on toxin variants having sequences that are less than 100% identical to the sequence of SEQ ID NO: 1 and SEQ ID NO: 2. In another embodiment, cross-reactivity refers to the ability to react with similar antigenic sites on a toxin variant having a sequence that is less than 100% identical to the respective sequence of TcdA001 (SEQ ID NO: 762) or TcdB001 (SEQ ID NO: 801).

In an exemplary embodiment, a composition comprising a polypeptide having the amino acid sequence SEQ ID NO: 4, wherein the methionine is not present (toxoid A), and a second polypeptide having the amino acid sequence SEQ ID NO: 6, wherein the methionine is not present (toxoid B), elicits cross-reactive antibodies and binding fragments thereof that bind to toxin A produced by a *C. difficile* strain, wherein the toxin A has an amino acid sequence that is less than 100% identical to SEQ ID NO: 1, and to toxin B produced by a *C. difficile* strain, wherein the toxin B has an amino acid sequence that is less than 100% identical to SEQ ID NO: 2.

Exemplary compositions are provided. For instance, compositions comprising an effective amount of *C. difficile* toxoid A and toxoid B (e.g., from about 40 to about 500 μg/dose, such as about any of 40, 50, 60, 70, 80, 90, 100, 1 10, 120, 130, 140, 1 50, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, or 500 μg/dose, such as about 50 to about 100 μg/dose (w/w, total amount of toxoids A and B in the composition)) at an effective toxoid A:B ratio (e.g., about any of 10%, 20%, 30%, 40%, 50%, 60%, 70%, 3:1, 3:2, or 1:1 toxoid A to toxoid B by weight), and with a sufficient purity (e.g., at least about 80 to about 100%, such as about any of 80, 85, 90, 95 or 90-100% (w/w)), using one or more administrations (e.g., at least two, three administrations or doses) by any suitable route (e.g., intramuscularly), each dose of a multiple dose administration regimen being suitably separated from one another (e.g., by at least about one to about ten days such as about any of one, two, three, four, five, six, seven, eight, nine or ten, such as about seven days) are provided. The length of time (time interval) between doses would be understood by those of ordinary skill to vary depending on the individual and that that interval should be long enough (e.g., as measured in days) such that the immune response from the prior dose both has time to develop (e.g., to be primed) and is not in any way inhibited by the subsequent dose (e.g., the boosting dose or doses).

In one embodiment, the composition used in the vaccination regimen of the present invention includes from about 40 to about 500 μg/dose of *C. difficile* toxoid A. In an embodiment the composition includes from about 50 to about 400 μg/dose of *C. difficile* toxoid A. In one embodiment, the composition includes from about 50 to about 200 μg/dose of *C. difficile* toxoid A. In one embodiment the composition includes from about 50 to about 150 μg/dose. In one embodiment the composition includes about any of 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, or 500 μg/dose of *C. difficile* toxoid A. In one embodiment, the composition includes about 50 μg/dose of *C. difficile* toxoid A. In another embodiment, the composition includes about 100 μg/dose of *C. difficile* toxoid A.

In one embodiment the composition used in the vaccination regimen of the present invention includes from about 40 to about 500 μg/dose of *C. difficile* toxoid B. In one embodiment the composition includes from about 50 to about 400 μg/dose of *C. difficile* toxoid B. In one embodiment the composition includes from about 50 to about 200 μg/dose of *C. difficile* toxoid B. In one embodiment the composition includes from about 50 to about 150 μg/dose. In one embodiment the composition includes about any of 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, or 500 μg/dose of *C. difficile* toxoid B. In one embodiment, the composition includes about 50 μg/dose of *C. difficile* toxoid B. In another embodiment, the composition includes about 100 μg/dose of *C. difficile* toxoid B.

In one embodiment the composition used in the vaccination regimen of the present invention includes *C. difficile* toxoid A and B at the doses disclosed herein. In one embodiment, the toxoid A to B ratio is 3:1, 3:2, or 1:1 toxoid A to toxoid B by weight. In one embodiment, the toxoid A to B ratio is 1:3, 2:3, or 1:1 toxoid A to toxoid B by weight. In one embodiment, the toxoid A to B ratio is 1:1 toxoid A to toxoid B by weight. In one embodiment the composition used in the vaccination regimen of the present invention includes *C. difficile* toxoid A and B with a purity of at least about 80 to about 100%. In one embodiment the composition used in the vaccination regimen of the present invention includes *C. difficile* toxoid A and B with a purity of at least about 90 to about 100%. In one embodiment the composition used in the vaccination regimen of the present invention includes *C. difficile* toxoid A and B with a purity of about 80, 85, 90, 95 or 100% (w/w).

In one embodiment the compositions disclosed herein are administered once. In one embodiment the compositions disclosed herein are administered two times. In one embodiment the compositions disclosed herein are administered three times. In one embodiment the compositions disclosed herein are administered four times.

In one embodiment the compositions disclosed herein are administered two times at the same dose. In one embodiment the compositions disclosed herein are administered three times at the same dose. In one embodiment the compositions disclosed herein are administered four times at the same dose.

In one embodiment the composition of the present invention is administered by any suitable route. In one embodiment, the compositions disclosed herein are administered by intramuscular, intraperitoneal, intradermal or subcutaneous routes. In one embodiment the compositions disclosed herein are administered subcutaneously or intramuscularly. In one embodiment the compositions disclosed herein are administered intramuscularly.

In one embodiment of the present invention, each dose of a multiple dose administration regimen is suitably separated from one another. In one embodiment, the compositions disclosed herein are administered two times each dose being separated from one another by about one to about ten days. In one embodiment, the compositions disclosed herein are administered two times each dose being separated from one another by about two to nine days. In one embodiment, the compositions disclosed herein are administered two times each dose being separated from one another by about one, two, three, four, five, six, seven, eight, nine or ten days. In one embodiment, the compositions disclosed herein are administered two times each dose being separated from one another by about six days. In one embodiment, the compositions disclosed herein are administered two times each dose being separated from one another by about seven days. In one embodiment, the compositions disclosed herein are administered two times each dose being separated from one another by about eight days. In one embodiment, the compositions disclosed herein are administered two times each dose being separated from one another by about one to about four months. In one embodiment, the compositions disclosed herein are administered two times each dose being separated from one another by about one, two, three or four months. In one embodiment, the compositions disclosed herein are administered two times each dose being separated from one another by about one month. In one embodiment, the compositions disclosed herein are administered two times each dose being separated from one another by about two months.

In one embodiment, the compositions disclosed herein are administered three times the first and second dose being separated from one another by about one to about ten days and the third dose being separated from the first dose by about 15 to 45 days. In one embodiment, the compositions disclosed herein are administered three times the first and second dose being separated from one another by about 5 to about 8 days and the third dose being separated from the first dose by about 20 to 35 days. In one embodiment, the compositions disclosed herein are administered three times the first and second dose being separated from one another by about 6 to about 7 days and the third dose being separated from the first dose by about 25 to 35 days. In one embodiment, the compositions disclosed herein are administered three times the first and second dose being separated from one another by about seven days and the third dose being separated from the first dose by about 30 days. In one embodiment, the compositions disclosed herein are administered three times the first and second dose being separated from one another by about one to about four months and the third dose being separated from the first dose by about 5 to 10 months. In one embodiment, the compositions disclosed herein are administered three times the first and second dose being separated from one another by about one to two months and the third dose being separated from the first dose by about 5 to 8 months. In one embodiment, the compositions disclosed herein are administered three times the first and second dose being separated from one another by about one month and the third dose being separated from the first dose by about 6 months. In one embodiment, the compositions disclosed herein are administered three times the first and second dose being separated from one another by about one month and the third dose being separated from the first dose by about 5 months. In one embodiment, the compositions disclosed herein are administered three times the first and second dose being separated from one another by about one month and the third dose being separated from the first dose by about 7 months.

In one embodiment, the compositions disclosed herein are administered four times the first and second dose being separated from one another by about one to about ten days, the third dose being separated from the first dose by about 15 to 45 days and the fourth and third dose being separated from one another by about 6 months to about 2 years. In one embodiment, the compositions disclosed herein are administered four times the first and second dose being separated from one another by about 5 to about 8 days, the third dose being separated from the first dose by about 20 to 35 days and the fourth and third dose being separated from one another by about 10 months to about 1.5 years. In one embodiment, the compositions disclosed herein are administered four times the first and second dose being separated from one another by about 6 to about 7 days, the third dose being separated from the first dose by about 25 to 35 days and the fourth and third dose being separated from one another by about 11 months to about 13 months. In one embodiment, the compositions disclosed herein are administered four times the first and second dose being separated from one another by about seven days, the third dose being separated from the first dose by about 30 days and the fourth and third dose being separated from one another by 1 year.

In one embodiment, the compositions disclosed herein are administered four times the first and second dose being separated from one another by about one to about four months, the third dose being separated from the first dose by about 5 to 10 months and the fourth dose being separated from the third dose by about 6 months to 2 years. In one embodiment, the compositions disclosed herein are administered four times the first and second dose being separated from one another by about one to two months, the third dose being separated from the first dose by about 5 to 8 months and the fourth dose being separated from the third dose by about 10 months to 1.5 years. In one embodiment, the compositions disclosed herein are administered four times the first and second dose being separated from one another by about one month, the third dose being separated from the first dose by about 6 months and the fourth dose being separated from the third dose by about 11 months to 13 months. In one embodiment, the compositions disclosed herein are administered four times the first and second dose being separated from one another by about one month, the third dose being separated from the first dose by about 6 months and the fourth dose being separated from the third dose by about 12 months.

In one embodiment the compositions given in any of the multi-dose regimen disclosed herein are given at the same dose (i.e. same quantity of C. difficile toxoid A and/or B). In one embodiment the compositions given in any of the multi-dose regimen disclosed herein are given at the same (i.e. same dose and same ingredients).

In one embodiment the compositions given in any of the multi-dose regimen disclosed herein are given at different doses. In one embodiment the compositions given in any of the multi-dose regimen disclosed herein are given at the same dose of antigen (i.e. same quantity of C. difficile toxoid A and/or B) but may comprise different ingredients (e.g. different adjuvants).

In some embodiments, the second administration is at least one, two, three, four, five, six, seven, eight, nine or ten days after the first administration (e.g., day 0) and the third administration is at least about 20-200 (e.g., about 20, 30, 40, 50, 60, 70, 80, 90, 100, 110, 120, 130, 140, 150, 160, 170, 180, 190, or 200, such as about 30 or about 180 days) days after the first administration. For instance, the method may comprise first, second and/or third administrations wherein the second administration is at least 7 days after the first administration and the third administration is at least about 30 days and/or at least about 180 days after the first or second administration. In some embodiments, the second administration is about seven days after the first administration and the third administration is about 30 days after the first administration.

Upon administration of such compositions using such methods to a host/subject, an immune response is typically observed, which typically includes a humoral immune response and may involve a cellular immune response.

In certain embodiments, the method may comprise administering the immunogenic composition to a human, subject at risk for infection. In some embodiments, the human subject may be at least about any of 40, 50, 65 years or older. In some embodiments, the human subject may be about 40 to about 65 years of age. In some embodiments, the human subject may be 65-75 years of age. Thus, methods for administering the compositions are also provided. Methods for making the compositions are described herein and are available to those of ordinary skill in the art.

In one aspect, the invention relates to methods for immunizing a subject (e.g., a human being) against *C. difficile* by administering thereto a composition comprising one or more antigens of *C. difficile*. In one aspect, the invention relates to a composition disclosed herein for use in a method for immunizing a subject against *C. difficile*. In one aspect, the invention relates to a composition disclosed herein for use in a method for immunizing a human subject against *C. difficile*. In one embodiment, the human subject is 40-90 years of age. In one embodiment, the human subject is 50-85 years of age. In one embodiment, the human subject is 60-85 years of age. In an embodiment, the human subject is 65-85 years of age. In one embodiment, the human subject is 65-69 years of age. In an embodiment, the human subject is 70-79 years of age. In one embodiment, the human subject is 75-79 years of age. In one embodiment, the human subject is at least 60, 61, 62, 63, 64, 65, 66, 67, 68, 69, 70, 71, 72, 73, 74, 75, 76, 77, 78, 79, 80, 81, 82, 83, 84, 85, 86, 87, 88, 89 or 90 years of age. In one embodiment, the human subject is at least 65, 66, 67, 68, 69, 70, 71, 72, 73, 74, 75, 76, 77, 78, 79, 80, 81, 82, 83, 84 or 85 years of age.

For instance, a suitable composition may comprise a total of about 50 or about 100 μg (or about 50-100 μg) *C. difficile* toxoid (toxoid A and toxoid B) at an approximate toxoid A to toxoid B ratio of about 3:2, with or without adjuvant (e.g., aluminum hydroxide). For comparison purposes, the antigen-containing composition may be administered to one group of subjects and a placebo composition (e.g., 0.9% normal saline) administered (e.g., on the same schedule) to another group. Immunological data and safety data may be obtained from the subjects on particular days (e.g., days 0, 14, 30, 60, 180, and/or 210, and/or up to 1000 days after the first administration). Administration of the composition may take place on, for example, days 0 (first administration), about day 7 (second administration), about day 30 (third administration) and/or about day 180 (alternative third administration or fourth administration).

The composition may comprise *C. difficile* toxoid A and toxoid B at an effective toxoid A:B ratio (e.g., about any of 3:1, 3:2, or 1:1 toxoid A to toxoid B by weight) at a sufficient purity (e.g., about 90% or higher purity (w/w)). For instance, the composition may comprise a highly purified (e.g., >90% (w/w/)) preparation of *C. difficile* toxoids A & B in an approximate toxoid A to toxoid B ratio of about 3:2. Such compositions may be prepared using any of the available methods of preparation, e.g., as described in WIPO Patent Application WO/2012/143902, U.S. Pat. No. 9,187,536, and WIPO Patent Application WO/2014/060898, which are each incorporated by reference herein in their respective entireties.

The term "*C. difficile* toxoid" is used herein to refer to a *C. difficile* toxin (Toxin A or Toxin B) that has been partially or completely inactivated. A toxin is inactivated if it has less toxicity (e.g., 100%, 99%, 98%, 80%, 70%, 60%, 50%, 40%, 30%, 20%, 10% or less toxicity or any value therebetween) than untreated toxin, as measured by for example an in vitro cytotoxicity assay or by animal toxicity. *C. difficile* toxoids can be produced by purification of toxins from *C. difficile* cultures and inactivation of toxins by chemical (e.g., formaldehyde, glutaraldehyde, peroxide or oxygen treatment). Alternatively, wild type or mutant *C. difficile* toxins that lack or have reduced toxicity can be produced using recombinant methods and/or alternative chemical crosslinking agents. For example, genetic mutations resulting in reduced toxicity can be made. Wild type or mutant *C. difficile* toxins lacking specific regions to reduce toxicity can also be made.

The *C. difficile* toxoid or mutant *C. difficile* toxin refers to a molecule that exhibits a structure or sequence that differs from the corresponding wild-type structure or sequence, e.g., by having crosslinks as compared to the corresponding wild-type structure and/or by having at least one mutation, as compared to the corresponding wild-type sequence when optimally aligned, such as by the programs GAP or BEST-FIT using default gap weights. The term toxoid or mutant toxin as used herein further exhibits a functional property (e.g., abrogated glucosyltransferase and/or abrogated cysteine protease activity) that differs from the corresponding wild-type molecule.

The toxoid as used herein may be any of the toxoids or mutant *C. difficile* toxins as described in WIPO Patent Application WO/2012/143902, U.S. Pat. No. 9,187,536, and WIPO Patent Application WO/2014/060898, which are each incorporated by reference herein in their respective entireties. That is, the toxoid as used herein may be any of the polypeptides as described in WIPO Patent Application WO/2012/143902, U.S. Pat. No. 9,187,536, and WIPO Patent Application WO/2014/060898, which are each incorporated by reference herein in their respective entireties. A *C. difficile* toxin from any of the wild-type strains described above may be used as a source from which a toxoid or mutant *C. difficile* toxin is produced. Preferably, *C. difficile* 630 is the source from which a *C. difficile* toxoid is produced.

In one embodiment, the toxoid refers to a polypeptide that has any one sequence selected from SEQ ID NO: 1 to SEQ ID NO: 840, wherein the initial methionine is absent, and wherein the polypeptide has been contacted with a chemical crosslinker, such as, for example, formaldehyde or EDC, as described herein, and/or has been genetically mutated. More specifically, in one embodiment, the toxoid is a polypeptide having the amino acid sequence set forth in any one of SEQ ID NOs: 1-8, 15, 17, 19, 21, 23, 25, 28-35, 82-761, and 762-840. In another embodiment, the polypeptide has an amino acid sequence that is about 60%, 65%, 70%, 75%, 80%, 85%, 86%, 87%, 88%, 89%, 90%, 91%, 92%, 93%, 94%, 95%, 96%, 97%, 98%, 99%, or 100% identical to any one of SEQ ID NOs: 1-8, 15, 17, 19, 21, 23, 25, 28-35, 82-761, and 762-840. In another embodiment, the polypeptide has an amino acid sequence having at least 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2150, or 2200 consecutive amino acids to any one of SEQ ID NOs: 1-8, 15, 17, 19, 21, 23, 25, 28-35, 82-761, and 762-840.

The mutation may involve a substitution, deletion, truncation or modification of the wild type amino acid residue normally located at that position. Accordingly, the polypeptide may be any one of a fusion polypeptide, glycosylated polypeptide, non-glycosylated polypeptide, lipidated polypeptide, non-lipidated polypeptide, phosphorylated polypeptide, non-phosphorylated polypeptide, myristoylated polypeptide, non-myristoylated polypeptide, monomeric polypeptide, multimeric polypeptide, particulate polypeptide, denatured polypeptide, etc. Preferably, the mutation is a non-conservative amino acid substitution. The mutant toxins of the invention may be prepared by techniques known in the art for preparing mutations, such as, for example, site-directed mutagenesis, mutagenesis using a mutagen (e.g., UV light), etc. Preferably, site-directed mutagenesis is used. Alternatively, a nucleic acid molecule having an objective sequence may be directly synthesized. Such chemical synthesis methods are known in the art.

In the present invention, the mutant *C. difficile* toxin includes at least one mutation in a glucosyltransferase domain, relative to the corresponding wild-type *C. difficile* toxin. In one embodiment, the glucosyltransferase domain includes at least two mutations. Preferably, the mutation decreases or abrogates glucosyltransferase enzyme activity of the toxin, as compared to the glucosyltransferase enzyme activity of the corresponding wild-type *C. difficile* toxin.

An exemplary *C. difficile* toxoid A includes a glucosyltransferase domain including SEQ ID NO: 29 having an amino acid substitution at positions 285 and 287, and a cysteine protease domain comprising SEQ ID NO: 32 having an amino acid substitution at position 158, relative to the corresponding wild-type *C. difficile* toxin A. For example, such a mutant *C. difficile* TcdA includes the amino acid sequence set forth in SEQ ID NO: 4, wherein the initial methionine is not present. In another embodiment, the mutant *C. difficile* toxin A includes the amino acid sequence set forth in SEQ ID NO: 84. Further examples of a *C. difficile* toxoid A include the amino acid sequence set forth in SEQ ID NO: 7, which has a D269A, R272A, D285A, D287A, E460A, R462A, and C700A mutation, as compared to SEQ ID NO: 1, wherein the initial methionine is optionally not present. In another embodiment, the mutant *C. difficile* toxin A includes the amino acid sequence set forth in SEQ ID NO: 83.

An exemplary *C. difficile* toxoid B includes the amino acid sequence set forth in SEQ ID NO: 6, wherein the initial methionine is not present. In another embodiment, the mutant *C. difficile* toxin A includes the amino acid sequence set forth in SEQ ID NO: 86. Further examples of a mutant *C. difficile* TcdB include the amino acid sequence set forth in SEQ ID NO: 8, which has a D270A, R273A, D286A, D288A, D461A, K463A, and C698A mutation, as compared to SEQ ID NO: 2, and wherein the initial methionine of SEQ ID NO: 8 is optionally not present. In another embodiment, the mutant *C. difficile* toxin B includes the amino acid sequence set forth in SEQ ID NO: 85.

In addition to generating an immune response in a mammal, the toxoids described herein also have reduced cytotoxicity compared to the corresponding wild-type *C. difficile* toxin. Preferably, the immunogenic compositions are safe and have minimal (e.g., about a 6-8 $\log_{10}$ reduction) to no cytotoxicity, relative to the cytotoxicity of a respective wild-type toxin, for administration in mammals.

As used herein, the term cytotoxicity is a term understood in the art and refers to apoptotic cell death and/or a state in which one or more usual biochemical or biological functions of a cell are aberrantly compromised, as compared to an identical cell under identical conditions but in the absence of the cytotoxic agent. Toxicity can be quantitated, for example, in cells or in mammals as the amount of an agent needed to induce 50% cell death (i.e., $EC_{50}$ or $ED_{50}$, respectively) or by other methods known in the art.

Assays for indicating cytotoxicity are known in the art, such as cell rounding assays. Additional exemplary cytotoxicity assays known in the art include glucosylation assays relating to phosphorimaging of Ras labeled with [$^{14}$C] glucose assays and preferably the in vitro cytotoxicity assay described in WIPO Patent Application WO/2012/143902, U.S. Pat. No. 9,187,536, and WIPO Patent Application WO/2014/060898, which are each incorporated by reference herein in their respective entireties, wherein $EC_{50}$ may refer to a concentration of an immunogenic composition that exhibits at least about 50% of cytopathogenic effect (CPE) in a cell, preferably a human diploid fibroblast cell (e.g., IMR90 cell (ATCC CCL-186™), as compared to an identical cell under identical conditions in the absence of the toxin. The in vitro cytotoxicity assay may also be used to assess the concentration of a composition that inhibits at least about 50% of a wild-type *C. difficile* toxin-induced cytopathogenic effect (CPE) in a cell, preferably a human diploid fibroblast cell (e.g., IMR90 cell (ATCC CCL-186™), as compared to an identical cell under identical conditions in the absence of the toxin.

In one embodiment, the cytotoxicity of the immunogenic composition is reduced by at least about 1000, 2000, 3000, 4000, 5000-, 6000-, 7000-, 8000-, 9000-, 10000-, 11000-, 12000-, 13000-fold, 14000-fold, 15000-fold, or more, as compared to the corresponding wild-type *C. difficile* toxin.

In another embodiment, the cytotoxicity of the immunogenic composition is reduced by at least about 2-$\log_{10}$, more preferably by about 3-$\log_{10}$, and most preferably by about 4-$\log_{10}$ or more, relative to the corresponding wild-type toxin under identical conditions. For example, a mutant *C. difficile* TcdB may have an $EC_{50}$ value of about $10^{-9}$ g/ml as measured in a standard cytopathic effect assay (CPE), as compared to an exemplary wild-type *C. difficile* TcdB which may have an $EC_{50}$ value of at least about $10^{-12}$ g/ml.

In yet another embodiment, the cytotoxicity of the mutant *C. difficile* toxin has an $EC_{50}$ of at least about 50 µg/ml, 100 µg/ml, 200 µg/ml, 300 µg/ml, 400 µg/ml, 500 µg/ml, 600 µg/ml, 700 µg/ml, 800 µg/ml, 900 µg/ml, 1000 µg/ml or greater, as measured by, for example, an in vitro cytotoxicity assay. Accordingly, in a preferred embodiment, the immunogenic compositions and mutant toxins are biologically safe for administration to mammals.

In one embodiment, the toxoid is a polypeptide that has any one sequence selected from SEQ ID NO: 1 to SEQ ID NO: 840, more specifically, the toxoid is a polypeptide having the amino acid sequence set forth in any one of SEQ ID NOs: 1-8, 15, 17, 19, 21, 23, 25, 28-35, 82-761, and 762-840, wherein the initial methionine is absent, and wherein the polypeptide has been contacted with a chemical crosslinker, such as, for example, formaldehyde or EDC, as described herein. Crosslinking (also referred to as "chemical inactivation" or "inactivation" herein) is a process of chemically joining two or more molecules by a covalent bond. The terms "crosslinking reagents," "crosslinking agents," and "crosslinkers" refer to molecules that are capable of reacting with and/or chemically attaching to specific functional groups (primary amines, sulfhydryls, carboxyls, carbonyls, etc.) on peptides, polypeptides, and/or proteins. In one embodiment, the molecule may contain two or more reactive ends that are capable of reacting with and/or chemically attaching to specific functional groups (primary amines, sulfhydryls, carboxyls, carbonyls, etc.) on peptides, polypeptides, and/or proteins. Preferably, the chemical crosslinking agent is water-soluble. In another preferred embodiment, the chemical crosslinking agent is a heterobifunctional crosslinker. In another embodiment, the chemical crosslinking agent is not a bifunctional crosslinker. Chemical crosslinking agents are known in the art.

Exemplary suitable chemical crosslinking agents include formaldehyde; formalin; acetaldehyde; propionaldehyde; water-soluble carbodiimides (RN=C=NR'), which include 1-Ethyl-3-(3-Dimethylaminopropyl)-Carbodiimide (EDC), 1-Ethyl-3-(3-Dimethylaminopropyl)-Carbodiimide Hydrochloride, 1-Cyclohexyl-3-(2-morpholinyl-(4-ethyl)carbodiimide metho-p-toluenesulfonate (CMC), N,N'-dicyclohexylcarbodiimide (DCC), and N,N'-diisopropylcarbodiimide (DIC), and derivatives thereof; and N-hydroxysuccinimide (NHS); phenylglyoxal; and/or UDP-dialdehyde.

Preferably, the crosslinking agent is EDC. When a mutant *C. difficile* toxin polypeptide is chemically modified by EDC (e.g., by contacting the polypeptide with EDC), in one embodiment, the polypeptide includes (a) at least one crosslink between a side chain of an aspartic acid residue of the polypeptide and a side chain of a lysine residue of the polypeptide. In one embodiment, the polypeptide includes (b) at least one crosslink between a side chain of a glutamic acid residue of the polypeptide and a side chain of a lysine residue of the polypeptide. In one embodiment, the polypeptide includes (c) at least one crosslink between the carboxyl group at the C-terminus of the polypeptide and the amino group of the N-terminus of the polypeptide. In one embodiment, the polypeptide includes (d) at least one crosslink between the carboxyl group at the C-terminus of the polypeptide and a side chain of a lysine residue of the polypeptide. In one embodiment, the polypeptide includes (e) at least one crosslink between a side chain of an aspartic acid residue of the polypeptide and a side chain of a lysine residue of a second isolated polypeptide. In one embodiment, the polypeptide includes (f) at least one crosslink between a side chain of a glutamic acid residue of the polypeptide and a side chain of a lysine residue of a second isolated polypeptide. In one embodiment, the polypeptide includes (g) at least one crosslink between the carboxyl group at the C-terminus of the polypeptide and the amino group of the N-terminus of a second isolated polypeptide. In one embodiment, the polypeptide includes (h) at least one crosslink between the carboxyl group at the C-terminus of the polypeptide and a side chain of a lysine residue of a second isolated polypeptide.

The "second isolated polypeptide" refers to any isolated polypeptide that is present during the reaction with EDC. In one embodiment, the second isolated polypeptide is a mutant *C. difficile* toxin polypeptide having an identical sequence as the first isolated polypeptide. In another embodiment, the second isolated polypeptide is a mutant *C. difficile* toxin polypeptide having a different sequence from the first isolated polypeptide.

In one embodiment, the polypeptide includes at least two modifications selected from the (a)-(d) modifications. In an exemplary embodiment, the polypeptide includes (a) at least one crosslink between a side chain of an aspartic acid residue of the polypeptide and a side chain of a lysine residue of the polypeptide and (b) at least one crosslink between a side chain of a glutamic acid residue of the polypeptide and a side chain of a lysine residue of the polypeptide. In a further embodiment, the polypeptide includes at least three modifications selected from the (a)-(d) modifications. In yet a further embodiment, the polypeptide includes the (a), (b), (c), and (d) modifications.

When more than one mutant polypeptide is present during chemical modification by EDC, in one embodiment, the resulting composition includes at least one of any of the (a)-(h) modifications. In one embodiment, the composition includes at least two modifications selected from the (a)-(h) modifications. In a further embodiment, the composition includes at least three modifications selected from the (a)-(h) modifications. In yet a further embodiment, the composition includes at least four modifications selected from the (a)-(h) modifications. In another embodiment, the composition includes at least one of each of the (a)-(h) modifications.

In an exemplary embodiment, the resulting composition includes (a) at least one crosslink between a side chain of an aspartic acid residue of the polypeptide and a side chain of a lysine residue of the polypeptide; and (b) at least one crosslink between a side chain of a glutamic acid residue of the polypeptide and a side chain of a lysine residue of the polypeptide. In one embodiment, the composition further includes (c) at least one crosslink between the carboxyl group at the C-terminus of the polypeptide and the amino group of the N-terminus of the polypeptide; and (d) at least one crosslink between the carboxyl group at the C-terminus of the polypeptide and a side chain of a lysine residue of the polypeptide.

In another exemplary embodiment, the resulting composition includes (e) at least one crosslink between a side chain of an aspartic acid residue of the polypeptide and a side chain of a lysine residue of a second isolated polypeptide; (f) at least one crosslink between a side chain of a glutamic acid residue of the polypeptide and a side chain of a lysine residue of a second isolated polypeptide; (g) at least one crosslink between the carboxyl group at the C-terminus of the polypeptide and the amino group of the N-terminus of a second isolated polypeptide; and (h) at least one crosslink between the carboxyl group at the C-terminus of the polypeptide and a side chain of a lysine residue of a second isolated polypeptide.

In a further exemplary embodiment, the resulting composition includes (a) at least one crosslink between a side chain of an aspartic acid residue of the polypeptide and a side chain of a lysine residue of the polypeptide; (b) at least one crosslink between a side chain of a glutamic acid residue of the polypeptide and a side chain of a lysine residue of the polypeptide; (e) at least one crosslink between a side chain of an aspartic acid residue of the polypeptide and a side chain of a lysine residue of a second isolated polypeptide; and (f) at least one crosslink between a side chain of a glutamic acid residue of the polypeptide and a side chain of a lysine residue of a second isolated polypeptide.

In a preferred embodiment, the chemical crosslinking agent includes formaldehyde, more preferably, an agent including formaldehyde in the absence of lysine. Glycine or other appropriate compound with a primary amine can be used as the quencher in crosslinking reactions. Accordingly, in another preferred embodiment, the chemical agent includes formaldehyde and use of glycine.

In yet another preferred embodiment, the chemical crosslinking agent includes EDC and NHS. As is known in the art, NHS may be included in EDC coupling protocols. However, the inventors surprisingly discovered that NHS may facilitate in further decreasing cytotoxicity of the mutant *C. difficile* toxin, as compared to the corresponding wild-type toxin, as compared to a genetically mutated toxin, and as compared to a genetically mutated toxin that has been chemically crosslinked by EDC. See, for example, Example 22 described in WIPO Patent Application WO/2012/143902, U.S. Pat. No. 9,187,536, and WIPO Patent Application WO/2014/060898, which are each incorporated by reference herein in their respective entireties. Accordingly, without being bound by mechanism or theory, a mutant toxin polypeptide having a beta-alanine moiety linked to a side chain of at least one lysine residue of the polypeptide (e.g., resulting from a reaction of the mutant toxin polypeptide, EDC, and NHS) may facilitate in further decreasing cytotoxicity of the mutant toxin, as compared to, for example, a *C. difficile* toxin (wild-type or mutant) wherein a beta-alanine moiety is absent.

Use of EDC and/or NHS may also include use of glycine or other appropriate compound with a primary amine as the quencher. Any compound having a primary amine may be used as a quencher, such as, for example glycine methyl ester and alanine. In a preferred embodiment, the quencher compound is a non-polymeric hydrophilic primary amine. Examples of a non-polymeric hydrophilic primary amine include, for example, amino sugars, amino alcohols, and amino polyols. Specific examples of a non-polymeric hydrophilic primary amine include glycine, ethanolamine, glucamine, amine functionalized polyethylene glycol, and amine functionalized ethylene glycol oligomers. In one embodiment, the chemical crosslinking agent does not include formaldehyde. In one embodiment, the chemical crosslinking agent does not include formalin.

In one aspect, the invention relates to a mutant *C. difficile* toxin, i.e., a polypeptide, having at least one amino acid side chain chemically modified by EDC and a non-polymeric hydrophilic primary amine, preferably glycine. The resulting glycine adducts (e.g., from a reaction of triple mutant toxins treated with EDC, NHS, and quenched with glycine) may facilitate in decreasing cytotoxicity of the mutant toxin as compared to the corresponding wild-type toxin.

In one embodiment, when a mutant *C. difficile* toxin, i.e., a polypeptide, is chemically modified by EDC and glycine, the polypeptide includes at least one modification when the polypeptide is modified by EDC (e.g., at least one of any of the (a)-(h) modifications described above), and at least one of the following exemplary modifications: (i) a glycine moiety linked to the carboxyl group at the C-terminus of the polypeptide; (j) a glycine moiety linked to a side chain of at least one aspartic acid residue of the polypeptide; and (k) a glycine moiety linked to a side chain of at least one glutamic acid residue of the polypeptide.

In one embodiment, at least one amino acid of the mutant *C. difficile* TcdA, i.e., the polypeptide, is chemically crosslinked and/or at least one amino acid of the mutant *C. difficile* TcdB, i.e., a polypeptide, is chemically crosslinked. Any of the mutant toxins, i.e., polypeptides, described herein may be chemically crosslinked. In another embodiment, at least one amino acid of the polypeptide having SEQ ID NO: 4, SEQ ID NO: 6, SEQ ID NO: 7, and/or SEQ ID NO: 8 is chemically crosslinked.

In one embodiment, at least one amino acid residue of a polypeptide having the amino acid sequence of any of SEQ ID NOs: 1 through SEQ ID NO: 840 is crosslinked. For example, in one embodiment, at least one amino acid residue of a polypeptide having the amino acid sequence set forth in any one of SEQ ID NOs: 1-8, 15, 17, 19, 21, 23, 25, 28-35, 82-761, and 762-840 is crosslinked.

In another embodiment, at least one amino acid residue of a polypeptide having the amino acid sequence of any of SEQ ID NOs: 762 through SEQ ID NO: 800 includes a modification as described above, e.g., any of the (a)-(k) modifications, such as (a) at least one crosslink between a side chain of an aspartic acid residue of the polypeptide and a side chain of a lysine residue of the polypeptide. In another embodiment, at least one amino acid residue of a polypeptide having the amino acid sequence of any of SEQ ID NOs: 801 through SEQ ID NO: 840 includes a modification as described above, e.g., any of the (a)-(k) modifications, such as (a) at least one crosslink between a side chain of an aspartic acid residue of the polypeptide and a side chain of a lysine residue of the polypeptide.

For example, the at least one amino acid may be chemically crosslinked by an agent that includes a carbodiimide, such as EDC. Carbodiimides may form a covalent bond between free carboxyl (e.g., from the side chains of aspartic acid and/or glutamic acid) and amino groups (e.g., in the side chain of lysine residues) to form stable amide bonds.

As another example, the at least one amino acid may be chemically crosslinked by an agent that includes NHS. NHS ester-activated crosslinkers may react with primary amines (e.g., at the N-terminus of each polypeptide chain and/or in the side chain of lysine residues) to yield an amide bond.

In another embodiment, the at least one amino acid may be chemically crosslinked by an agent that includes EDC and NHS. For example, in one embodiment, the invention relates to an isolated polypeptide having the amino acid sequence set forth in SEQ ID NO: 4, wherein the methionine residue at position 1 is optionally not present, wherein the polypeptide includes at least one amino acid side chain chemically modified by EDC and NHS. In another embodiment, the invention relates to an isolated polypeptide having the amino acid sequence set forth in SEQ ID NO: 6, wherein the methionine residue at position 1 is optionally not present, wherein the polypeptide includes at least one amino acid side chain chemically modified by EDC and NHS. In yet another embodiment, the invention relates to an isolated polypeptide having the amino acid sequence set forth in SEQ ID NO: 84, SEQ ID NO: 86, SEQ ID NO: 83, SEQ ID NO: 85, SEQ ID NO: 7, or SEQ ID NO: 8. The polypeptide is modified by contacting the polypeptide with EDC and NHS.

When a mutant *C. difficile* toxin, i.e., a polypeptide, is chemically modified by (e.g., by contacting) EDC and NHS, in one embodiment, the polypeptide includes at least one modification when the polypeptide is modified by EDC (e.g., at least one of any of the (a)-(h) modifications described above), and (I) a beta-alanine moiety linked to a side chain of at least one lysine residue of the polypeptide.

In another aspect, the invention relates to a mutant *C. difficile* toxin, i.e., a polypeptide, wherein the polypeptide includes at least one amino acid side chain chemically modified by EDC, NHS, and a non-polymeric hydrophilic primary amine, preferably glycine. In one embodiment, the polypeptide includes at least one modification when the polypeptide is modified by EDC (e.g., at least one of any of the (a)-(h) modifications described above), at least one modification when the polypeptide is modified by glycine (e.g., at least one of any of the (i)-(k) modifications described above), and (I) a beta-alanine moiety linked to a side chain of at least one lysine residue of the polypeptide.

In one aspect, the invention relates to a mutant *C. difficile* toxin, i.e., a polypeptide, wherein a side chain of at least one lysine residue of the polypeptide is linked to a beta-alanine moiety. In one embodiment, a side chain of a second lysine residue of the polypeptide is linked to a side chain of an aspartic acid residue and/or to a side chain of a glutamic acid residue. The "second" lysine residue of the polypeptide includes a lysine residue of the polypeptide that is not linked to a beta-alanine moiety. The side chain of an aspartic acid and/or the side chain of a glutamic acid to which the second lysine residue is linked may be that of the polypeptide to form an intra-molecular crosslink, or that of a second polypeptide to form an inter-molecular crosslink. In another embodiment, a side chain of at least one aspartic acid residue and/or a side chain of at least one glutamic acid residue of the polypeptide is linked to a glycine moiety. The aspartic acid residue and/or the glutamic acid residue that is linked to a glycine moiety is not also linked to a lysine residue.

In another aspect, the invention relates to a mutant *C. difficile* toxin, i.e., a polypeptide, wherein at least one amino acid side chain of a wild-type *C. difficile* toxin is chemically modified. In one embodiment, at least one amino acid side chain of a wild-type *C. difficile* toxin A and/or at least one amino acid side chain of a wild-type *C. difficile* toxin B is chemically modified by EDC. For example, in one embodiment, TcdA (SEQ ID NO: 1) and/or TcdB (SEQ ID NO: 2) is chemically modified by EDC. In another embodiment, the wild-type toxin is chemically modified by EDC and NHS. In one embodiment, the mutant toxin, i.e., polypeptide, includes a chemically modified wild-type toxin A, wherein the wild-type toxin A is any one described in Table 1. In another embodiment, the mutant toxin, i.e., polypeptide, includes a chemically modified wild-type toxin B, wherein the wild-type toxin B is any one described in Table 2.

TABLE 1

| Wild-type *C. difficile* Strains | |
| --- | --- |
| *C. difficile* Strain ID | Toxin A, SEQ ID NO: |
| 2004013 | SEQ ID NO: 87 |
| 2004111 | SEQ ID NO: 88 |
| 2004118 | SEQ ID NO: 89 |
| 2004205 | SEQ ID NO: 90 |
| 2004206 | SEQ ID NO: 91 |
| 2005022 | SEQ ID NO: 92 |
| 2005088 | SEQ ID NO: 93 |
| 2005283 | SEQ ID NO: 94 |
| 2005325 | SEQ ID NO: 95 |
| 2005359 | SEQ ID NO: 96 |
| 2006017 | SEQ ID NO: 97 |
| 2006376 | N/A |
| 2007070 | SEQ ID NO: 98 |
| 2007217 | SEQ ID NO: 99 |
| 2007302 | SEQ ID NO: 100 |
| 2007816 | SEQ ID NO: 101 |
| 2007838 | SEQ ID NO: 102 |
| 2007858 | SEQ ID NO: 103 |
| 2007886 | SEQ ID NO: 104 |
| 2008222 | SEQ ID NO: 105 |
| 2009078 | SEQ ID NO: 106 |
| 2009087 | SEQ ID NO: 107 |
| 2009141 | SEQ ID NO: 108 |
| 2009292 | SEQ ID NO: 109 |
| 001 | SEQ ID NO: 148 |
| 002 | SEQ ID NO: 149 |
| 003 | SEQ ID NO: 150 |
| 012 (004) | SEQ ID NO: 151 |
| 014 | SEQ ID NO: 134 |
| 015 | SEQ ID NO: 135 |
| 017 | |
| 020 | SEQ ID NO: 136 |
| 023 | SEQ ID NO: 137 |
| 027 | SEQ ID NO: 138 |
| 029 | SEQ ID NO: 139 |

TABLE 1-continued

| Wild-type *C. difficile* Strains | |
| --- | --- |
| *C. difficile* Strain ID | Toxin A, SEQ ID NO: |
| 046 | SEQ ID NO: 140 |
| 053 | SEQ ID NO: 168 |
| 059 | SEQ ID NO: 178 |
| 070 | SEQ ID NO: 152 |
| 075 | SEQ ID NO: 153 |
| 077 | SEQ ID NO: 154 |
| 078 | SEQ ID NO: 169 |
| 081 | SEQ ID NO: 155 |
| 087 | SEQ ID NO: 170 |
| 095 | SEQ ID NO: 171 |
| 106 | SEQ ID NO: 180 |
| 117 | SEQ ID NO: 156 |
| 126 | SEQ ID NO: 172 |
| 131 | SEQ ID NO: 157 |
| SE844 | SEQ ID NO: 196 |
| 12087 | SEQ ID NO: 197 |
| K14 | SEQ ID NO: 198 |
| BI6 | SEQ ID NO: 199 |
| BI17 | SEQ ID NO: 200 |
| CH6230 | SEQ ID NO: 201 |
| SE881 | SEQ ID NO: 202 |

TABLE 2

| Wild-type *C. difficile* Strains | |
| --- | --- |
| *C. difficile* Strain ID | Toxin B, SEQ ID NO: |
| 2004013 | SEQ ID NO: 110 |
| 2004111 | SEQ ID NO: 111 |
| 2004118 | SEQ ID NO: 112 |
| 2004205 | SEQ ID NO: 113 |
| 2004206 | SEQ ID NO: 114 |
| 2005022 | SEQ ID NO: 115 |
| 2005088 | SEQ ID NO: 116 |
| 2005283 | SEQ ID NO: 117 |
| 2005325 | SEQ ID NO: 118 |
| 2005359 | SEQ ID NO: 119 |
| 2006017 | SEQ ID NO: 120 |
| 2006376 | SEQ ID NO: 121 |
| 2007070 | SEQ ID NO: 122 |
| 2007217 | SEQ ID NO: 123 |
| 2007302 | SEQ ID NO: 124 |
| 2007816 | SEQ ID NO: 125 |
| 2007838 | SEQ ID NO: 126 |
| 2007858 | SEQ ID NO: 127 |
| 2007886 | SEQ ID NO: 128 |
| 2008222 | SEQ ID NO: 129 |
| 2009078 | SEQ ID NO: 130 |
| 2009087 | SEQ ID NO: 131 |
| 2009141 | SEQ ID NO: 132 |
| 2009292 | SEQ ID NO: 133 |
| 001 | SEQ ID NO: 158 |
| 002 | SEQ ID NO: 159 |
| 003 | SEQ ID NO: 160 |
| 012 (004) | SEQ ID NO: 161 |
| 014 | SEQ ID NO: 141 |
| 015 | SEQ ID NO: 142 |
| 017 | SEQ ID NO: 182 |
| 020 | SEQ ID NO: 143 |
| 023 | SEQ ID NO: 144 |
| 027 | SEQ ID NO: 145 |
| 029 | SEQ ID NO: 146 |
| 046 | SEQ ID NO: 147 |
| 053 | SEQ ID NO: 173 |
| 059 | SEQ ID NO: 179 |
| 070 | SEQ ID NO: 162 |
| 075 | SEQ ID NO: 163 |
| 077 | SEQ ID NO: 164 |
| 078 | SEQ ID NO: 174 |
| 081 | SEQ ID NO: 165 |
| 087 | SEQ ID NO: 175 |
| 095 | SEQ ID NO: 176 |

TABLE 2-continued

| Wild-type C. difficile Strains | |
|---|---|
| C. difficile Strain ID | Toxin B, SEQ ID NO: |
| 106 | SEQ ID NO: 181 |
| 117 | SEQ ID NO: 166 |
| 126 | SEQ ID NO: 177 |
| 131 | SEQ ID NO: 167 |

As yet another example of a chemically crosslinked mutant *C. difficile* toxin, i.e., a polypeptide, the at least one amino acid may be chemically crosslinked by an agent that includes formaldehyde. Formaldehyde may react with the amino group of an N-terminal amino acid residue and the side-chains of arginine, cysteine, histidine, and lysine. Formaldehyde and glycine may form a Schiff-base adduct, which may attach to primary N-terminal amino groups, arginine, and tyrosine residues, and to a lesser degree asparagine, glutamine, histidine, and tryptophan residues.

A chemical crosslinking agent is said to reduce cytotoxicity of a toxin if the treated toxin has less toxicity (e.g., about 100%, 99%, 95%, 90%, 80%, 75%, 60%, 50%, 25%, or 10% less toxicity) than untreated toxin under identical conditions, as measured, for example, by an in vitro cytotoxicity assay, or by animal toxicity.

Preferably, the chemical crosslinking agent reduces cytotoxicity of the mutant *C. difficile* toxin by at least about a $2\text{-log}_{10}$ reduction, more preferably about a $3\text{-log}_{10}$ reduction, and most preferably about a $4\text{-log}_{10}$ or more, relative to the mutant toxin under identical conditions but in the absence of the chemical crosslinking agent. As compared to the wild-type toxin, the chemical crosslinking agent preferably reduces cytotoxicity of the mutant toxin by at least about a $5\text{-log}_{10}$ reduction, about a $6\text{-log}_{10}$ reduction, about a $7\text{-log}_{10}$ reduction, about an $8\text{-log}_{10}$ reduction, or more.

In another preferred embodiment, the chemically inactivated mutant *C. difficile* toxin, i.e., a polypeptide, exhibits $EC_{50}$ value of greater than or at least about 50 μg/ml, 100 μg/ml, 200 μg/ml, 300 μg/ml, 400 μg/ml, 500 μg/ml, 600 μg/ml, 700 μg/ml, 800 μg/ml, 900 μg/ml, 1000 μg/ml or greater, as measured by, for example, an in vitro cytotoxicity assay, such as one described herein.

Reaction conditions for contacting the mutant toxin with the chemical crosslinking agent are within the scope of expertise of one skilled in the art, and the conditions may vary depending on the agent used. However, the inventors surprisingly discovered optimal reaction conditions for contacting a mutant *C. difficile* toxin, i.e., a polypeptide, with a chemical crosslinking agent, while retaining functional epitopes and decreasing cytotoxicity of the mutant toxin, as compared to the corresponding wild-type toxin.

Preferably, the reaction conditions are selected for contacting a mutant toxin with the crosslinking agent, wherein the mutant toxin has a minimum concentration of about 0.5, 0.75, 1.0, 1.25, 1.5, 1.75, 2.0 mg/ml to a maximum of about 3.0, 2.5, 2.0, 1.5, or 1.25 mg/ml. Any minimum value may be combined with any maximum value to define a range of suitable concentrations of a mutant toxin for the reaction. Most preferably, the mutant toxin has a concentration of about 1.0-1.25 mg/ml for the reaction.

In one embodiment, the agent used in the reaction has a minimum concentration of about 1 mM, 2 mM, 3 mM, 4 mM, 5 mM, 10 mM, 15 mM, 20 mM, 30 mM, 40 mM, or 50 mM, and a maximum concentration of about 100 mM, 90 mM, 80 mM, 70 mM, 60 mM, or 50 mM. Any minimum value may be combined with any maximum value to define a range of suitable concentrations of the chemical agent for the reaction.

In a preferred embodiment wherein the agent includes formaldehyde, the concentration used is preferably any concentration between about 2 mM to 80 mM, most preferably about 40 mM. In another preferred embodiment wherein the agent includes EDC, the concentration used is preferably any concentration between about 1.3 mM to about 13 mM, more preferably about 2 mM to 3 mM, most preferably about 2.6 mM. In one embodiment, the concentration of EDC is at most 5 g/L, 4 g/L, 3 g/L, 2.5 g/L, 2 g/L, 1.5 g/L, 1.0 g/L, 0.5 g/L based on the total reaction volume, preferably at most 1 g/L, more preferably at most 0.5 g/L.

Exemplary reaction times in which the mutant toxin is contacted with the chemical crosslinking agent include a minimum of about 0.5, 1, 2, 3, 4, 5, 6, 12, 24, 36, 48, or 60 hours, and a maximum of about 14 days, 12 days, 10 days, 7 days, 5 days, 3 days, 2 days, 1 day, or 12 hours, 11, 10, 9, 8, 7, 6, 5, 4, 3, 2, or 1 hour. Any minimum value may be combined with any maximum value to define a range of suitable reaction times.

In a preferred embodiment, the step of contacting the mutant toxin with the chemical crosslinking agent occurs for a period of time that is sufficient to reduce cytotoxicity of the mutant *C. difficile* toxin to an $EC_{50}$ value of at least about 1000 μg/ml in a suitable human cell, e.g., IMR-90 cells, in a standard in vitro cytotoxicity assay, as compared to an identical mutant toxin in the absence of the crosslinking agent. More preferably, the reaction step is carried out for a time that is at least twice as long, and most preferably at least three times as long or more, as the period of time sufficient to reduce the cytotoxicity of the mutant toxin to an $EC_{50}$ value of at least about 1000 μg/ml in a suitable human cell. In one embodiment, the reaction time does not exceed about 168 hours (or 7 days).

For example, in one embodiment wherein the agent includes formaldehyde, the mutant toxin is preferably contacted with the agent for about 12 hours, which was shown to be an exemplary period of time that was sufficient to reduce cytotoxicity of the mutant *C. difficile* toxin to an $EC_{50}$ value of at least about 1000 μg/ml in a suitable human cell, e.g., IMR-90 cells, in a standard in vitro cytotoxicity assay, as compared to an identical mutant toxin in the absence of the crosslinking agent. In a more preferred embodiment, the reaction is carried out for about 48 hours, which is at least about three times as long as a sufficient period of time for the reaction. In such an embodiment, the reaction time is preferably not greater than about 72 hours.

In another embodiment wherein the agent includes EDC, the mutant toxin is preferably contacted with the agent for about 0.5 hours, more preferably at least about 1 hour, or most preferably about 2 hours. In one embodiment, the mutant toxin is contacted with EDC for at most about 5 hours, preferably at most about 3 hours, more preferably at most about 2 hours. In such an embodiment, the reaction time is preferably not greater than about 6 hours.

Exemplary pH at which the mutant toxin is contacted with the chemical crosslinking agent include a minimum of about pH 5.5, 6.0, 6.5, 7.0, or 7.5, and a maximum of about pH 8.5, 8.0, 7.5, 7.0, or 6.5. Any minimum value may be combined with any maximum value to define a range of suitable pH. Preferably, the reaction occurs at pH 6.5 to 7.5, preferably at pH 7.0.

Exemplary temperatures at which the mutant toxin is contacted with the chemical crosslinking agent include a minimum of about 2° C., 4° C., 10° C., 20° C., 25° C., or 37°

C., and a maximum temperature of about 40° C., 37° C., 30° C., 27° C., 25° C., or 20° C. Any minimum value may be combined with any maximum value to define a range of suitable reaction temperature. Preferably, the reaction occurs at about 20° C. to 30° C., most preferably at about 25° C.

The immunogenic compositions described above may include one mutant *C. difficile* toxin (A or B), i.e., polypeptides. Accordingly, the immunogenic compositions can occupy separate vials (e.g., a separate vial for a composition including mutant *C. difficile* toxin A and a separate vial for a composition including mutant *C. difficile* toxin B) in the preparation or kit. The immunogenic compositions may be intended for simultaneous, sequential, or separate use.

In another embodiment, the immunogenic compositions described above may include both mutant *C. difficile* toxins (A and B), i.e., polypeptides. Any combination of mutant *C. difficile* toxin A and mutant *C. difficile* toxin B described may be combined for an immunogenic composition. Accordingly, the immunogenic compositions can be combined in a single vial (e.g., a single vial containing both a composition including mutant *C. difficile* TcdA and a composition including mutant *C. difficile* TcdB). Preferably, the immunogenic compositions include a mutant *C. difficile* TcdA and a mutant *C. difficile* TcdB, i.e., polypeptides.

For example, in one embodiment, the immunogenic composition includes SEQ ID NO: 4 and SEQ ID NO: 6, wherein at least one amino acid of each of SEQ ID NO: 4 and SEQ ID NO: 6 is chemically crosslinked. In another embodiment, the immunogenic composition includes a mutant *C. difficile* toxin A, which includes SEQ ID NO: 4 or SEQ ID NO: 7, and a mutant *C. difficile* toxin B, which comprises SEQ ID NO: 6 or SEQ ID NO: 8, wherein at least one amino acid of each of the mutant *C. difficile* toxins is chemically cross-linked.

In another embodiment, the immunogenic composition includes any sequence selected from SEQ ID NO: 4, SEQ ID NO: 84, and SEQ ID NO: 83, and any sequence selected from SEQ ID NO: 6, SEQ ID NO: 86, and SEQ ID NO: 85. In another embodiment, the immunogenic composition includes SEQ ID NO: 84 and an immunogenic composition including SEQ ID NO: 86. In another embodiment, the immunogenic composition includes SEQ ID NO: 83 and an immunogenic composition including SEQ ID NO: 85. In another embodiment, the immunogenic composition includes SEQ ID NO: 84, SEQ ID NO: 83, SEQ ID NO: 86, and SEQ ID NO: 85.

In another embodiment, the immunogenic composition includes a polypeptide having any one sequence selected from SEQ ID NO: 1 to SEQ ID NO: 840, and a second polypeptide having any one sequence selected from SEQ ID NO: 1 to SEQ ID NO: 840, wherein the polypeptide has been contacted with a chemical crosslinker, such as, for example, formaldehyde or EDC, as described herein. For example, in one embodiment, the immunogenic composition includes a first polypeptide having the amino acid sequence set forth in any one of SEQ ID NOs: 1-8, 15, 17, 19, 21, 23, 25, 28-35, 82-840 and a second polypeptide having the amino acid sequence set forth in any one of SEQ ID NOs: 1-8, 15, 17, 19, 21, 23, 25, 28-35, 82-840, wherein the first polypeptide and the second polypeptide has been contacted with a chemical crosslinker, such as, for example, formaldehyde or EDC, as described herein.

In certain embodiments, it is preferred that the compositions described herein exhibit immunogenic properties (e.g., inducing a detectable and/or neutralizing and/or protective immune response) following appropriate administration to a subject. The presence of neutralizing and/or protective immune response may be demonstrated as described above and/or by showing that infection by a pathogen (e.g., *C. difficile*) is affected (e.g., decreased) in individuals (e.g., human being or other animal) to whom the materials described herein have been administered as compared to individuals to whom the materials have not been administered. For instance, one or more test subjects (e.g., human or non-human) may be administered by any suitable route and schedule a composition described herein, and then after a suitable amount of time (e.g., about 1, 2, 3, 4, 5, 6, 7, 8, 9, or 10 weeks) challenged by a pathogenic organism. The animal(s) may be monitored for immune function (e.g., antibody production, T cell activity) following administration and/or challenge. Sera may be analyzed for total antibody response or for expression of particular subtypes using, for example, an antibody ELISA and/or a pathogen neutralization assay. T cell activity may be measured by, for example, measuring IFN-γ production after re-stimulation with the antigen. Statistical analysis (e.g., Fisher's exact test, Wilcoxon test, Mann-Whitney Test) may then be performed on data to determine whether the effectiveness of the material in affecting the immune response.

The *C. difficile* toxoids A and/or B as described herein may be combined with one or more pharmaceutically acceptable carriers to provide a composition prior to administration to a host. A pharmaceutically acceptable carrier is a material that is not biologically or otherwise undesirable, e.g., the material may be administered to a subject, without causing any undesirable biological effects or interacting in a deleterious manner with any of the other components of the pharmaceutical composition in which it is contained. The carrier would naturally be selected to minimize any degradation of the active ingredient and to minimize any adverse side effects in the subject, as would be well known to one of skill in the art. Suitable pharmaceutical carriers and their formulations are described in, for example, Remington's: The Science and Practice of Pharmacy, 27⁴ᵗ Edition, David B. Troy, ed., Lippicott Williams & Wilkins (2005), and may be appropriate Typically, an appropriate amount of a pharmaceutically-acceptable salt is used in the formulation to render the formulation isotonic. Examples of the pharmaceutically-acceptable carriers include, but are not limited to, sterile water, saline, buffered solutions like Ringer's solution, and dextrose solution. The pH of the solution is generally from about 5 to about 8 or from about 7 to about 7.5. Other carriers include sustained-release preparations such as semipermeable matrices of solid hydrophobic polymers containing polypeptides or fragments thereof. Matrices may be in the form of shaped articles, e.g., films, liposomes or microparticles. It will be apparent to those persons skilled in the art that certain carriers may be more preferable depending upon, for instance, the route of administration and concentration of composition being administered. Carriers are those suitable for administration to humans or other subjects. As referred to above, an immunological composition is typically one that comprises *C. difficile* antigen(s) and, upon administration to a host (e.g., an animal), induces or enhances an immune response directed against the antigen (e.g., *C. difficile*). Such responses may include the generation of antibodies (e.g., through the stimulation of B cells) or a T cell-based response (e.g., a cytolytic response), as described above, which may be protective and/or neutralizing. A protective or neutralizing immune response may be one that is detrimental to the infectious organism corresponding to the antigen (e.g., from which the antigen was derived) and beneficial to the host (e.g., by reducing or preventing infection). As used herein, protective or neutralizing antibodies and/or cellular responses may be reactive with the *C. difficile* antigen(s) described here, especially when administered in an effective amount and/or schedule. Those antibodies and/or cellular responses may reduce or inhibit the severity, time, and/or lethality of *C. difficile* infection when tested in animals. As shown in the examples, the compositions described herein may be used to induce an immune response against *C. difficile*. An immunological composition that, upon administration to a host, results in a therapeutic (e.g., typically administered during an active infection) and/or protective (e.g., typically administered before or after an active infection) and/or neutralizing immune response, may be considered a vaccine.

In one aspect, the present invention relates to a composition that includes any of the compositions described herein (such as, e.g., compositions including a mutant *C. difficile* toxin, immunogenic compositions, antibodies and/or antigen binding fragments thereof described herein), formulated together with a pharmaceutically acceptable carrier.

In one embodiment, the composition induces an immune response. In a preferred embodiment, use of the composition reduces the incidence of a first primary episode of a *C. difficile* infection. The incidence may be reduced after the first administration of the composition, after the second administration of the composition, and/or after the third administration of the composition, as compared to the incidence prior to a first administration of the composition. In another embodiment, use of the composition reduces the incidence of recurrent *C. difficile* infection. The incidence of recurrent infection may be reduced after the first administration of the composition, after the second administration of the composition, and/or after the third administration of the composition.

In another embodiment, use of the composition reduces the severity of a *C. difficile* infection. For example, the duration of an episode of a *C. difficile* infection may be reduced after the first administration of the composition, after the second administration of the composition, and/or after the third administration of the composition, as compared to the incidence prior to a first administration of the composition. An episode of a *C. difficile* infection may include, for example, at least two days of passing at least three unformed stools and/or a need for antibiotic treatment for *C. difficile* infection. The duration of an episode of a *C. difficile* infection may be considered reduced if the patient has had at least two days without passage of at least three or more unformed stools and/or there is no further need for antibiotic treatment for *C. difficile* infection.

In some embodiments, methods for preventing, ameliorating, reducing the risk of and/or treating (e.g., affecting) infection by *C. difficile* are also provided. Methods for treating one or more disease conditions caused by or involving *C. difficile* in a subject comprising administering to the subject at least one or more effective doses of a composition described herein (e.g., comprising *C. difficile* antigens, e.g., toxoid A, toxoid B). The antigens may be administered in a dosage amount of about 1 to about 300 μg (e.g., about any of 1, 2, 3, 4, 5, 6, 7, 8, 9, 10, 1 5, 20, 30, 35, 40, 45, 50, 55, 60, 65, 70, 75, 80, 85, 90, 95, 100, 110, 120, 130, 140, 150, 160, 170, 180, 190, 200, 210, 220, 230, 240, 250, 260, 270, 280, 290 and/or 300 μg). The antigens may be administered more than once in the same or different dosage amounts. In certain embodiments, the *C. difficile* antigens may be administered to the subject by the same or different suitable route(s) one, two, three, four, five, six, seven, eight, nine, ten, or more times. When multiple doses are administered, the doses may comprise about the same or different type and/or amount of *C. difficile* antigens in each dose. The doses may also be separated in time from one another by the same or different intervals. For instance, the doses may be separated by about any of 6, 12, 24, 36, 48, 60, 72, 84, or 96 hours, seven days, 14 days, 21 days, 30 days, 40 days, 50 days, 60 days, 70 days, 80 days, 90 days, 100 days, 1 10 days, 120 days, 130 days, 140 days, 150 days, 160 days, 170 days, 180 days, 190 days, 200 days, one week, two weeks, three weeks, one month, two months, three months, four months, five months, six months, seven months, eight months, nine months, 10 months, 1 1 months, 12 months, 1.5 years, 2 years, 3 years, 4 years, 5 years, or any time period before, after, and/or between any of these time periods. In some embodiments, the *C. difficile* antigens may be administered alone or in conjunction with other agents (e.g., antibiotics) Such other agents may be administered simultaneously (or about simultaneously) with the same or different *C. difficile* antigens, or at a different time and/or frequency. Other embodiments of such methods may also be appropriate as could be readily determined by one of ordinary skill in the art.

Also provided are methods for immunizing a subject (such as a human being) by administering thereto any such compositions. In some embodiments, the methods may comprise administering to the subject an immunogenic composition (e.g., a vaccine) comprising an effective amount (e.g., at least about 40 to about 500, such about 50 to about 100 μg) of *C. difficile* toxoid A and toxoid B (combined w/w) at an effective toxoid A:B ratio (e.g., 3:1, 3:2, 1:1 by weight (w/w)), and with a sufficient purity (e.g., at least 90% (w/w)), using one or more administrations (e.g., at least three times, each dose being suitably separated from one another (e.g., at least about 7 days)). An effective toxoid A:B ratio is any ratio that may be included in a composition and induce an effective immune response against *C. difficile* toxin A and/or toxin B.

In one embodiment, the method may comprise first, second and third administrations wherein the second administration is at least 7 days after the first administration and the third administration is at least about 30 days and/or at least about 180 days after the first and/or second administration.

In some embodiments, the methods may enhance and/or induce an existing immune response in a human being previously exposed to *C. difficile* (e.g., a seropositive human being, an anamnestic immune response).

In one embodiment, the human has had an unplanned hospitalization within the 12 months prior to the first administration of the composition. In another embodiment, the human has had a skilled nursing facility (a residential institution that provides professional nursing care and rehabilitation services, usually following discharge from hospital) stay within the 12 months prior to the first administration of the composition. In another embodiment, the human has had a nursing home (e.g., a residential institution that provides professional nursing care and rehabilitation services, usually following discharge from a hospital) stay within the 12 months prior to the first administration of the composition. In another embodiment, the human has had two or more emergency room visits within the 12 months prior to the first administration of the composition. In another embodiment, the human has had 10 or more outpatient visits (primary and/or secondary care visits but excluding pharmacy and mental health visits) within the 12 months prior to the first administration of the composition.

In another embodiment, the human has been administered systemic antibiotic use within the 12 weeks prior to the first administration of the composition. In another embodiment, the human has a significant co-morbidity or contact with health care systems within the 12 months prior to the first administration of the composition. In another embodiment, the human has had 1 in-patient hospitalization nights within the 12 months prior to the first administration of the composition. In another embodiment, the human has had 2 emergency room visits within the 12 months prior to the first administration of the composition. In another embodiment, the human has had 10 out-patient visits within the 12 months prior to the first administration of the composition. In another embodiment, the human has a residence in a skilled nursing facility within the 12 months prior to the first administration of the composition. In another embodiment, the human has a residence in a nursing home within the 12 months prior to the first administration of the composition. In another embodiment, the human has an in-patient hospitalization nights scheduled ≥37 days after randomization within the 12 months prior to the first administration of the composition. In another embodiment, the human has received systemic antibotics at any time within the previous 12 weeks prior to the first administration of the composition. In certain embodiments, the human works at or has contact with any one of the following facilities within the 12 months prior to the first administration of the composition: a hospital, skilled nursing facility (a residential institution that provides professional nursing care and rehabilitation services, usually following discharge from hospital), a nursing home (e.g., a residential institution that provides professional nursing care and rehabilitation services, usually following discharge from a hospital), emergency room, and out-patient facility (primary and/or secondary care visits but excluding pharmacy and mental health visits).

In certain embodiments, human being(s) may have had, in the 12 month period before the first administration, at least one or two hospital stays, each lasting at least about 24, 48 or 72 hours or more, and/or had received systemic (not topical) antibiotics; and/or, is anticipated to have an in-patient hospitalization for a planned surgical procedure within about 60 days of the first administration. In some embodiments, the anticipated/impending hospital stay/hospitalization may be planned to be for about 24, 48 to 72 hours or more and may be for a surgery involving at least one of the kidney/bladder/urinary system, musculoskeletal system, respiratory system, circulatory system, and central nervous system.

It is preferred that the immune response elicited by these methods is sufficient to prevent and/or ameliorate and/or reduce the risk of symptomatic *C. difficile* infection. In certain embodiments, the method may comprise administering the immunogenic composition to a human subject at risk for a symptomatic infection that is at least about 40, 50 or 65, 70, 75, 80, or 85 years of age. In some embodiments, the method may comprise administering the composition to each individual of a group aged between about 40 and about 65 years old and/or between about 65 and about 75 years old. In some embodiments, the method may induce about a two- to four-fold enhancement of an antibody-based immune response against *C. difficile* toxin A and/or toxin B in about any of 80, 85, 90, 95 or 100% of a population of individuals considered seropositive before the first administration as measured by, e.g., ELISA and/or TNA. In some embodiments, the method may induce about a two- to four-fold enhancement of an antibody-based immune response against *C. difficile* toxin A and/or toxin B in about any of 20, 25, 30, 35, 40, 45, or 50% of a population of individuals considered seronegative before administration of the composition, as measured by, e.g., ELISA and/or TNA 14 days after the first administration (e.g., following administration at days 0, seven and 30). In some embodiments, the method may induce about a two- to four-fold enhancement of an antibody-based immune response against *C. difficile* toxin A and/or toxin B in about any of 30, 35, 40, 45, 50, 55, 60, 65, 70, 75, or 80% of a population of individuals considered seronegative before administration of the composition, as measured by, e.g., ELISA and/or TNA 60 days after the first administration (e.g., following administration at days 0, seven and 30). In some embodiments, the individuals in such populations are from about 40 to about 65 years old. In some embodiments, the individuals in such populations are from about 50 to 75 years old or about 50 years old to about 65 years old. In some embodiments, this enhancement is observed about 30 days after the first administration (at day 0), typically follows a second administration at about day 7, and is typically observed before the third administration (at, e.g., about day 30 or day 180). In some embodiments, the immune response may be detectable against toxin A and/or toxin B for up to about 30 months (e.g., about 1000 days) after the first, second and/or third administration in a multiple regimen administration protocol. In some embodiments, administration of a composition described herein to a human subject at day 0 (first administration), about day 7 (second administration) and about day 30 (third administration) enhances or induces an immune response against *C. difficile* toxin A and/or toxin B for up to about 30 months, or about 1000 days as measured by, e.g., ELISA and/or TNA, preferably by a cytoxicity assay. In some embodiments, the level of the immune response may be about at least as high on about day 1000 following the first administration as on about day 14 following the first administration of a three dose administration regimen, as measured by, e.g., ELISA and/or TNA, preferably by a cytoxicity assay. In some embodiments, the level of the immune response may be about at least as high on about any of days 100, 200, 300, 400, 500, 600, 700, 800, 900 and 1000 following the first administration as on about day 14 following the first administration as measured by, e.g., ELISA and/or TNA, preferably by a cytoxicity assay. In some embodiments, the immune response may be about two- to eight-fold above baseline (e.g., antitoxin A and/or toxin B antibody levels at day 0, before the first administration, as measured by e.g., ELISA and/or TNA. In some embodiments, the immune response may be from about 2.5 to about 6.8-fold above baseline as measured by e.g., ELISA and/or TNA, preferably by a cytoxicity assay. In some embodiments, the immune response in seropositive individuals (e.g., non-naive) is increased from baseline by a factor of about three at about day 7; about 10 to about 70 at about day 14; about 30 to about 200 at about day 30; and about 100 to about 200 at about day 60, as measured by ELISA for toxins A and/or B (e.g., following administration at days 0, 7 and 30). In some embodiments, the immune response in seropositive individuals (e.g., non-naive) is increased from baseline by a factor of about three at about day 7; about 10 to about 100 at about day 14; about 1 5 to about 1 30 at about day 30; and about 100 to about 130 at about day 60, as measured by TNA for toxins A and/or B (e.g., following administration at days 0, seven and 30). In some embodiments, the immune response in seronegative individuals (e.g., naive) is increased from baseline by a factor of about two at about day 14; about five to about 10 at about day 30; and about 25 to about 60 at about day 60, as measured by ELISA for toxins A and/or B (e.g., following administration at days 0, seven and 30). In some embodiments, the immune response in seronegative individuals (e.g., naive) is increased from baseline by a factor of about two to about three at about day 14; about two to about five at about day 30; and about five to about 40 at about day 60, as measured by TNA for toxins A and/or B (e.g., following administration at days 0, 7 and 30). In some embodiments, the immune responses described herein are detected in individuals considered either seropositive or seronegative at day 0 (e.g., before the first administration). In some embodiments, such immune response is detected for both *C. difficile* toxin A and toxin B as measured by, e.g., ELISA and/or TNA, preferably by a cytotoxicity assay. Methods (e.g., in vitro or in vivo) for producing such *C. difficile* antigens (e.g., toxoids A and/or B), and compositions comprising the same, are also provided. Such methods may include, for example, any of those available and/or known to those of ordinary skill in the art, and/or the methods described in WIPO Patent Application WO/2012/143902, U.S. Pat. No. 9,187,536, and WIPO Patent Application WO/2014/060898, which are each incorporated by reference herein in their respective entireties.

As used herein, a subject or a host is meant to be an individual. The subject can include domesticated animals, such as cats and dogs, livestock (e.g., cattle, horses, pigs, sheep, and goats), laboratory animals (e.g., mice, rabbits, rats, guinea pigs) and birds. In one aspect, the subject is a mammal such as a primate or a human.

Composition and Vaccine

In one embodiment, the composition is an immunogenic composition. In one embodiment, the composition is an immunogenic composition for a human. In another embodiment, the composition is a vaccine. A "vaccine" refers to a composition that includes an antigen, which contains at least one epitope that induces an immune response that is specific for that antigen. The vaccine may be administered directly into the subject by subcutaneous, oral, oronasal, or intranasal routes of administration. Preferably, the vaccine is administered intramuscularly. In one embodiment, the composition is a human vaccine. In one embodiment, the composition is an immunogenic composition against *C. difficile*.

In certain embodiments, the compositions may further comprise one or more *C. difficile* antigens, one or more pharmaceutically acceptable carriers and/or one or more adjuvants (e.g., aluminum salt, emulsion, cationic liposome, anionic polymer, Toll-like receptor agonist, CpG and a combination thereof).

In one embodiment, the composition, which may be a vaccine, may be provided as a lyophilized formulation that may be reconstituted at the clinical site with diluent, and mixed with either adjuvant (e.g., an aluminum adjuvant such as aluminum phosphate or aluminum hydroxide or water for injection (WFI), when specified.

In one embodiment, the composition includes a pharmaceutically acceptable carrier(s), which refer to any solvents, dispersion media, stabilizers, diluents, and/or buffers that are physiologically suitable. Exemplary stabilizers include carbohydrates, such as sorbitol, mannitol, starch, dextran, sucrose, trehalose, lactose, and/or glucose; inert proteins, such as albumin and/or casein; and/or other large, slowly metabolized macromolecules, such as polysaccharides such as chitosan, polylactic acids, polyglycolic acids and copolymers (such as latex functionalized SEPHAROSE™ agarose, agarose, cellulose, etc.), amino acids, polymeric amino acids, amino acid copolymers, and lipid aggregates (such as oil droplets or liposomes). Additionally, these carriers may function as immunostimulating agents (i.e., adjuvants).

Preferably, the composition includes trehalose. Preferred amounts of trehalose (% by weight) include from a minimum of about 1%, 2%, 3%, or 4% to a maximum of about 10%, 9%, 8%, 7%, 6%, or 5%. Any minimum value can be combined with any maximum value to define a suitable range. In one embodiment, the composition includes about 3%-6% trehalose, most preferably, 4.5% trehalose, for example, per 0.5 mL dose.

Examples of suitable diluents include distilled water, saline, physiological phosphate-buffered saline, glycerol, alcohol (such as ethanol), Ringers solutions, dextrose solution, Hanks' balanced salt solutions, and/or a lyophilization excipient. The diluent may be, for example, any pharmaceutically acceptable diluent (e.g., 20 mM Sodium Citrate, 5% Sucrose, and 0.016% Formaldehyde; 10 nM Citrate, 4% Sucrose, 0.008% Formaldehyde, 0.57% Sodium Chloride). In a preferred embodiment, the composition includes 10 mM Tris, 4.5%, Trehalose, 0.01% Polysorbate 80 (PS80), pH 7.4

Exemplary buffers include phosphate (such as potassium phosphate, sodium phosphate); acetate (such as sodium acetate); succinate (such as sodium succinate); glycine; histidine; carbonate, Tris (tris(hydroxymethyl)aminomethane), and/or bicarbonate (such as ammonium bicarbonate) buffers. Preferably, the composition includes tris buffer. Preferred amounts of tris buffer include from a minimum of about 1 mM, 5 mM, 6 mM, 7 mM, 8 mM, 9 mM, 10 mM to a maximum of about 100 mM, 50 mM, 20 mM, 19 mM, 18 mM, 17 mM, 16 mM, 15 mM, 14 mM, 13 mM, 12 mM, or 11 mM. Any minimum value can be combined with any maximum value to define a suitable range. In one embodiment, the composition includes about 8 mM to 12 mM tris buffer, most preferably, 10 mM tris buffer, for example, per 0.5 mL dose.

In another preferred embodiment, the composition includes histidine buffer. Preferred amounts of histidine buffer include from a minimum of about 1 mM, 5 mM, 6 mM, 7 mM, 8 mM, 9 mM, 10 mM to a maximum of about 100 mM, 50 mM, 20 mM, 19 mM, 18 mM, 17 mM, 16 mM, 15 mM, 14 mM, 13 mM, 12 mM, or 11 mM. Any minimum value can be combined with any maximum value to define a suitable range. In one embodiment, the composition includes about 8 mM to 12 mM histidine buffer, most preferably, 10 mM histidine buffer, for example, per 0.5 mL dose.

In yet another preferred embodiment, the composition includes phosphate buffer. Preferred amounts of phosphate buffer include from a minimum of about 1 mM, 5 mM, 6 mM, 7 mM, 8 mM, 9 mM, 10 mM to a maximum of about 100 mM, 50 mM, 20 mM, 19 mM, 18 mM, 17 mM, 16 mM, 15 mM, 14 mM, 13 mM, 12 mM, or 11 mM. Any minimum value can be combined with any maximum value to define a suitable range. In one embodiment, the composition includes about 8 mM to 12 mM phosphate buffer, most preferably, 10 mM phosphate buffer, for example, per 0.5 mL dose.

The pH of the buffer will generally be chosen to stabilize the active material of choice, and can be ascertainable by those in the art by known methods. Preferably, the pH of the buffer will be in the range of physiological pH. Thus, preferred pH ranges are from about 3 to about 8; more preferably, from about 6.0 to about 8.0; yet more preferably, from about 6.5 to about 7.5; and most preferably, at about 7.0 to about 7.2.

In another embodiment, the compositions described herein may include an adjuvant, as described below. Preferred adjuvants augment the intrinsic immune response to an immunogen without causing conformational changes in the immunogen that may affect the qualitative form of the immune response. Exemplary adjuvants include 3 De-O- acylated monophosphoryl lipid A (MPL™) (see GB 2220211 (GSK)); an aluminum hydroxide gel such as ALHYDROGEL™ (Brenntag Biosector, Denmark); aluminum salts (such as aluminum hydroxide, aluminum phosphate, aluminum sulfate), which may be used with or without an immunostimulating agent such as MPL or 3-DMP, QS-21, polymeric or monomeric amino acids such as polyglutamic acid or polylysine. Yet another exemplary adjuvant is an immunostimulatory oligonucleotide such as a CpG oligonucleotide (see, e.g., WO 1998/040100, WO2010/067262), or a saponin and an immunostimulatory oligonucleotide, such as a CpG oligonucleotide (see, e.g., WO 00/062800). In a preferred embodiment, the adjuvant is a CpG oligonucleotide, most preferably a CpG oligodeoxynucleotides (CpG ODN). Preferred CpG ODN are of the B Class that preferentially activate B cells. In aspects of the invention, the CpG ODN has the nucleic acid sequence 5' T*C*G*T*C*G*T*T*T*T*T*C*G*G*T*G*C*T*T*T*T 3' (SEQ ID NO: 48) wherein * indicates a phosphorothioate linkage. The CpG ODN of this sequence is known as CpG 24555, which is described in WO2010/067262. In a preferred embodiment, CpG 24555 is used together with an aluminium hydroxide salt such as ALHYDROGEL. A further class of exemplary adjuvants include saponin adjuvants, such as STIMULON™ (QS-21, which is a triterpene glycoside or saponin, Aquila, Framingham, Mass.) or particles generated therefrom such as ISCOMs (immune stimulating complexes) and ISCOMATRIX® adjuvant. Accordingly, the compositions of the present invention may be delivered in the form of ISCOMs, ISCOMS containing CTB, liposomes or encapsulated in compounds such as acrylates or poly(DL-lactide-co-glycoside) to form microspheres of a size suited to adsorption. Typically, the term "ISCOM" refers to immunogenic complexes formed between glycosides, such as triterpenoid saponins (particularly Quil A), and antigens which contain a hydrophobic region. In a preferred embodiment, the adjuvant is an ISCOMATRIX adjuvant. Other exemplary adjuvants include RC-529, GM-CSF and Complete Freund's Adjuvant (CFA) and Incomplete Freund's Adjuvant (IFA). Yet another class of exemplary adjuvants is glycolipid analogues including N-glycosylamides, N-glycosylureas and N-glycosylcarbamates, each of which is substituted in the sugar residue by an amino acid. Optionally, the pharmaceutical composition includes two or more different adjuvants. Preferred combinations of adjuvants include any combination of adjuvants including, for example, at least two of the following adjuvants: alum, MPL, QS-21, ISCOMATRIX, CpG, and ALHYDROGEL. An exemplary combination of adjuvants includes a combination of CpG and ALHYDROGEL. In some embodiments, the composition includes an adjuvant, wherein the adjuvant is QS-21. In some embodiments, the composition includes an adjuvant, wherein the adjuvant is QS-21 and does not further comprise another adjuvant. In some embodiments, the composition includes an adjuvant, wherein the adjuvant is QS-21 and does not further comprise MPL. In some embodiments, the composition includes an adjuvant, wherein the adjuvant is QS-21 and does not further comprise a phospholipid. In some embodiments, the composition includes an adjuvant, wherein the adjuvant is QS-21 and further comprises MPL. In some embodiments, the composition includes an adjuvant, wherein the adjuvant is QS-21 and further comprises a phospholipid.

The adjuvant may comprise, for instance, a suitable concentration (e.g., about any of 800-1600 µg/mL) of an adjuvant, such, as an adjuvant comprising aluminum (e.g., aluminum hydroxide or aluminum phosphate) in WFI. For instance, the adjuvant (e.g., 800-1600 g/mL aluminum hydroxide in 0.57% Sodium Chloride) may be used as the diluent to reconstitute the lyophilized formulation. WFI may be used to dilute the lyophilized vaccine for the unadjuvanted formulations. The final dosing solution may comprise, for instance, composition/vaccine, diluent and adjuvant.

Alternatively, in one embodiment, the composition is administered to the mammal in the absence of an adjuvant. That is, the composition does not comprise an adjuvant.

In some embodiments, the composition includes a surfactant. Any surfactant is suitable, whether it is amphoteric, non-ionic, cationic or anionic. Exemplary surfactants include the polyoxyethylene sorbitan esters surfactants (e.g., TWEEN®), such as polysorbate 20 and/or polysorbate 80; polyoxyethylene fatty ethers derived from lauryl, cetyl, stearyl and oleyl alcohols (known as BRIJ surfactants), such as triethyleneglycol monolauryl ether (BRIJ 30); TRITON X 100, or t-octylphenoxypolyethoxyethanol; and sorbitan esters (commonly known as the SPANs), such as sorbitan trioleate (SPAN 85) and sorbitan monolaurate, and combinations thereof. Preferred surfactants include polysorbate 80 (polyoxyethylene sorbitan monooleate).

Polysorbate 80 (PS-80) is a non-ionic surfactant. In one embodiment, the composition includes a PS-80 concentration ranging from 0.0005% to 1%. For example, the PS-80 concentration in the composition may be at least 0.0005%, 0.005%, 0.01%, 0.02%, 0.03%, 0.04%, 0.05%, 0.06%, 0.07%, 0.08%, 0.09%, 0.10%, 0.2%, 0.3%, 0.4%, 0.5%, 0.6%, 0.7%, 0.8%, 0.9%, 1%, or 1.1% PS-80. In one embodiment, the PS-80 concentration in the composition may be at most 2.0%, 1.9%, 1.8%, 1.7%, 1.6%, 1.5%, 1.4%, 1.3%, 1.2%, 1.1%, 1.0%, 0.9%, 0.8%, or 0.7% PS-80. Any minimum value may be combined with any maximum value described herein to define a range. Preferably, the composition comprises 0.01% PS-80.

In an exemplary embodiment, the immunogenic composition includes trehalose and phosphate 80. In another exemplary embodiment, the immunogenic composition includes tris buffer and polysorbate 80. In another exemplary embodiment, the immunogenic composition includes histidine buffer and polysorbate 80. In yet another exemplary embodiment, the immunogenic composition includes phosphate buffer and polysorbate 80.

In one exemplary embodiment, the immunogenic composition includes trehalose, tris buffer and polysorbate 80. In another exemplary embodiment, the immunogenic composition includes trehalose, histidine buffer and polysorbate 80. In yet another exemplary embodiment, the immunogenic composition includes trehalose, phosphate buffer and polysorbate 80.

In some embodiments, the pharmaceutical composition further includes formaldehyde. For example, in a preferred embodiment, a pharmaceutical composition that further includes formaldehyde has an immunogenic composition, wherein the mutant *C. difficile* toxin of the immunogenic composition has been contacted with a chemical crosslinking agent that includes formaldehyde. The amount of formaldehyde present in the pharmaceutical composition may vary from a minimum of about 0.001%, 0.002%, 0.003%, 0.004%, 0.005%, 0.006%, 0.007%, 0.008%, 0.009%, 0.010%, 0.013%, or 0.015%, to a maximum of about 0.020%, 0.019%, 0.018%, 0.017% 0.016%, 0.015%, 0.014%, 0.013%, 0.012% 0.011% or 0.010%. Any minimum value can be combined with any maximum value to define a suitable range. In one embodiment, the pharmaceutical composition includes about 0.010% formaldehyde.

In some alternative embodiments, the pharmaceutical compositions described herein do not include formaldehyde. For example, in a preferred embodiment, a pharmaceutical composition that does not include formaldehyde has an immunogenic composition, wherein at least one amino acid of the mutant *C. difficile* toxin is chemically crosslinked by an agent that includes EDC. More preferably, in such an embodiment, the mutant *C. difficile* toxin has not been contacted with a chemical crosslinking agent that includes formaldehyde. As another exemplary embodiment, a pharmaceutical composition that is in a lyophilized form does not include formaldehyde.

Also provided herein are kits for administering the *C. difficile* antigens. In one embodiment, one or more of *C. difficile* antigens may form part of and/or be provided as a kit for administration to a subject. Instructions for administering the *C. difficile* antigens may also be provided by the kit. Compositions comprising *C. difficile* antigens as described herein may be included in a kit (e.g., a vaccine kit). For example, the kit may comprise a first container containing a composition described herein in dried or lyophilized form and a second container containing an aqueous solution for reconstituting the composition. The kit may optionally include the device for administration of the reconstituted liquid form of the composition (e.g., hypodermic syringe, microneedle array) and/or instructions for use. The device for administration may be supplied pre-filled with an aqueous solution for reconstituting the composition.

The volume of each delivered dose of study drug (vaccine or placebo) may be about 0.5 mL. The volume of each delivered dose of the composition disclosed herein may be about 0.2, 0.3, 0.4, 0.5, 0.6, 0.7; 0.8, 0.9 or 1 mL. The volume of each delivered dose of the composition disclosed herein may be about 0.4, 0.5, 0.6 ml. The volume of each delivered dose of the composition disclosed herein may be about 0.5 mL. The volume of each delivered dose of the composition disclosed herein may be about 1 mL. Formulations may be administered by any suitable route (e.g., subcutaneously, intravenously, intramuscularly, intraperitoneally, intradermally, intranodally, intranasally, orally).

Toxin Neutralizing Activity

Immune response induced by administering the composition to a human may be determined using a toxin neutralization assay (TNA), ELISA, or more preferably, a cytotoxicity assay, such as that described in WIPO Patent Application WO/2012/143902, U.S. Pat. No. 9,187,536, and WIPO Patent Application WO/2014/060898, which are each incorporated by reference herein in their respective entireties.

The in vitro cytotoxicity assay is a key safety assay developed for testing of any potential residual cytotoxicity in drug substance material. Measurement of any potential residual cytotoxicity in toxoid A is accomplished using an IMR-90 cell-based assay. The wild-type *C. difficile* toxin A exhibits potent in vitro cytotoxicity, with small amounts of the toxin being sufficient to cause various effects on mammalian cells such as cell rounding (cytopathic effect or CPE) and lack of metabolic activity (as measured by ATP levels). The CPE assay is conducted by incubating toxoid material with the IMR90 cells in culture at 500 mcg/mL at 37° C., and evaluating for cell rounding 24 hours later. The CPE assay requires a subjective visual assessment of CPE by trained analysts and thus cannot be easily validated. The cytotoxicity release assay has been developed based on measurement of the amount of luminescence signal generated from ATP, which is proportional to the number of metabolically active cells following treatment with either toxoid A or wild-type toxin. The results are expressed as $EC_{50}$, which is defined as the amount of toxin or toxoid that causes a 50% reduction in ATP levels as measured in relative light units. The toxoid is tested at a concentration of 100 mcg/mL. This method was chosen for release and stability (limited time points) testing because it is more robust, objective, and suitable for GMP testing than an alternative cytopathogenic effect (CPE) assay. The cytotoxicity assay is run only on the toxoid because it can be tested at a higher concentration as compared to the drug product material without matrix interference. This ensures that the measurement is made at the most concentrated stage during the *C. difficile* vaccine production cycle. In addition, the cytotoxicity assay will be conducted on stability to monitor any potential reversion to toxicity.

The in vitro cytotoxicity assay is a key safety assay developed for testing of any potential residual cytotoxicity in drug substance material. Measurement of any potential residual cytotoxicity in toxoid B is accomplished using an IMR-90 cell-based assay. The wild-type *C. difficile* toxin B exhibits potent in vitro cytotoxicity, with small amounts of the toxin being sufficient to cause various effects on mammalian cells such as cell rounding (cytopathic effect or CPE) and lack of metabolic activity (as measured by ATP levels). The CPE assay is conducted by incubating DS material with the IMR90 cells in culture at 500 mcg/mL at 37° C., and evaluating for cell rounding 24 hours later. The CPE assay requires a subjective visual assessment of CPE by trained analysts and thus cannot be easily validated. The cytotoxicity release assay has been developed based on measurement of the amount of luminescence signal generated from ATP, which is proportional to the number of metabolically active cells following treatment with either toxoid B or wild-type toxin B. The results are expressed as $EC_{50}$, which is defined as the amount of toxin or toxoid that causes a 50% reduction in ATP levels as measured in relative light units. The maximum concentration of toxoid that was originally tested in this assay was 200 mcg/mL. However, method performance over time suggested that an upper concentration of only 100 mcg/mL can be consistently supported. This method was chosen for release and stability (limited time points) testing because it is more robust, objective, and suitable for GMP testing than an alternative CPE assay. The cytotoxicity assay is run only on the toxoid B drug substance material because it can be tested at a higher concentration as compared to the drug product material without matrix interference. This ensures that the measurement is made at the most concentrated stage during the *C. difficile* vaccine production cycle. In addition, the cytotoxicity assay will be conducted on stability to monitor any potential reversion to toxicity. To qualify the 50% neutralization titer assay for clinical use, provide further robustness to the assay, and assure consistent long-term performance in clinical development, a reference standard and appropriate controls were added to the assay, thereby permitting the read out of a neutralization titer as neutralization units/mL defined by the reference standard. Prior to analysis of the current study, serum samples from vaccinated humans were used to demonstrate a linear relationship between 50% neutralization titers and neutralization units/mL when performing the neutralization assay. Based on these correlation studies, "protective" neutralization threshold values were calculated and used to analyze the clinical data in this study.

In one embodiment, the TNA is an automated and sensitive assay based on luminescence readout. Neutralization titers of test samples are calculated based on a Reference standard. In one embodiment, the assay LLOQ for Txd A is 158.0 U/ml; Txd B=249.5 U/ml.

For the immunogenicity analyses, the "protective" thresholds for antitoxin A- and antitoxin B-neutralizing antibody responses were 219 and 2586 neutralization units/mL, respectively. Several of the immunogenicity endpoints for Study B5091009 were assessed based upon these "protective" thresholds.

As used herein, unless expressly defined otherwise, the "specified threshold" value is defined as 219 neutralization units/mL for toxin A and 2586 neutralization units/mL for toxin B.

In one embodiment, the immune response induced in the human is neutralizing against a *C. difficile* strain that expresses a toxin A having an amino acid sequence that has at least 80%, 81%, 82%, 83%, 84%, 85%, 86%, 87%, 88%, 89%, 90%, 91%, 92%, 93%, 94%, 95%, 96%, 97%, 98%, 99%, or 100% identity to the toxoid A of the composition.

In another embodiment, the immune response induced in the human is neutralizing against a *C. difficile* strain that expresses a toxin B including an amino acid sequence that has at least 80%, 81%, 82%, 83%, 84%, 85%, 86%, 87%, 88%, 89%, 90%, 91%, 92%, 93%, 94%, 95%, 96%, 97%, 98%, 99%, or 100% identity to the toxoid B of the composition.

The usefulness (e.g., immunogenicity) of any of the materials (e.g., compositions) and/or methods described herein may be assayed by any of the variety of methods known to those of skill in the art. Any one or more of the assays described herein, or any other one or more suitable assays, may be used to determine the suitability of any of the materials described herein for an intended purpose. It is to be understood that these methods are exemplary and non-limiting; other assays may also be suitable. For instance, the compositions described herein typically induce and/or enhance the production of antibodies against *C. difficile* upon administration to a subject. Such antibodies may be detected in the subject using any of the methods available to those of ordinary skill in the art. For instance, as described in the Examples section, serum may be obtained from a subject and tested by ELISA to detect immunoglobulin type G (IgG) antibodies to *C. difficile* toxin A and/or toxin B (e.g., "primary immunogenicity data"). Antibodies present in test sera may be reacted with toxin A or B antigens adsorbed to individual wells of a microtiter plate. The amount of antibody bound to the antigen coated wells may be determined using a colorimetric substrate reaction after binding of a secondary anti-IgG (e.g., anti-human IgG) antibody-enzyme conjugate. Substrate for the enzyme is then typically added that causes colorimetric change that was directly proportional to the antibody bound to the antigen. The concentration of antibodies in serum may be derived by extrapolation from a standard curve, which was generated from multiple dilutions of a reference standard serum with defined IgG units (ELISA unit (EU)/mL)). A toxin neutralization assay (TNA) may also be used to quantitate neutralizing antibodies to *C. difficile* toxin. In this assay, serial diluted serum may be incubated with a fixed amount of *C. difficile* toxin A or B. Test cells (e.g., Vero cells) may then then added and serum-toxin-cell mixture incubated under appropriate conditions (e.g., 37° C. for 6 days). The ability of the sera to neutralize the cytotoxic effect of the *C. difficile* toxin may be determined by and correlated to the viability of the cells. The assay utilizes the accumulation of acid metabolites in closed culture wells as an indication of normal cell respiration. In cells exposed to toxin, metabolism and $CO_2$ production is reduced; consequently, the pH rises (e.g., to 7.4 or higher) as indicated by the phenol red pH indicator in the cell culture medium. At this pH, the medium appears red. Cell controls, or cells exposed to toxin which have been neutralized by antibody, however, metabolize and produce $CO_2$ in normal amounts; as a result, the pH is maintained (e.g., at 7.0 or below) and at this pH, the medium appears yellow. Therefore, *C. difficile* toxin neutralizing antibodies correlate with the ability of the serum to neutralize the metabolic effects of *C. difficile* toxin on cells as evidenced by their ability to maintain a certain pH (e.g., of 7.0 or lower). The color change of the media may be measured (e.g., at 562 nm to 630 nm) using a plate reader to further calculate the antitoxin neutralizing antibody titer at 50% inhibition of the *C. difficile* toxin-mediated cytotoxicity. In one embodiment, the composition induces a toxin neutralizing antibody titer that is at least greater than 1-fold, such as, for example, at least 1.01-fold, 1.1-fold, 1.5-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 32-fold, or higher in the human after receiving a dose of the composition than a toxin neutralizing antibody titer in the human prior to receiving said dose, when measured under identical conditions in a toxin neutralization assay.

Titers

In one embodiment, the composition induces an increase in toxin neutralizing antibody titer in the human, as compared to the toxin neutralizing antibody titer in the human prior to administration of a dose of the composition, when measured under identical conditions in, for example, a cytotoxicity assay. In one embodiment, the increase in toxin neutralizing titer is compared to the toxin neutralizing titer in the human before administration of the first dose of the composition, as compared to the toxin neutralizing titer in the human prior to administration of the first dose of the composition, when measured under identical conditions in, for example, a cytotoxicity assay. In another embodiment, the increase in titer is observed after a second dose of the composition, as compared to the toxin neutralizing titer in the human prior to administration of the first dose of the composition, when measured under identical conditions in, for example, a cytotoxicity assay. In another embodiment, the increase in toxin neutralizing titer is observed after a third dose of the composition, as compared to the toxin neutralizing titer in the human prior to administration of the first dose of the composition, when measured under identical conditions in, for example, a cytotoxicity assay. In another embodiment, the increase in titer is observed after a second dose of the composition, as compared to the toxin neutralizing titer in the human prior to administration of the second dose of the composition, when measured under identical conditions in, for example, a cytotoxicity assay. In another embodiment, the increase in toxin neutralizing titer is observed after a third dose of the composition, as compared to the toxin neutralizing titer in the human prior to administration of the third dose of the composition, when measured under identical conditions in, for example, a cytotoxicity assay.

In one embodiment, the composition induces a toxin neutralizing titer in the human after administration of a dose, wherein the toxin neutralizing titer is at least greater than 1-fold higher than the toxin neutralizing titer in the human prior to administration of the dose, when measured under identical conditions in, for example, a cytotoxicity assay. For example, the toxin neutralizing titer may be at least 1.01-fold, 1.1-fold, 1.5-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 32-fold, or 64-fold higher in the human after receiving a dose of the composition, as compared to the toxin neutralizing titer in the human prior to administration of the dose, when measured under identical conditions in, for example, a cytotoxicity assay.

In one embodiment, a "responder" refers to a human, wherein the composition induces a toxin neutralizing titer in the human after administration of a dose, wherein the toxin neutralizing titer is at least greater than 1-fold higher than the toxin neutralizing titer in the human prior to administration of the dose. In a preferred embodiment, the responder achieves at least a 4-fold rise in toxin neutralizing titer, as compared to a toxin neutralizing titer in the human prior to administration of the dose. Such a responder may be referred to as having a protective titer.

In one embodiment, the composition induces a toxin neutralizing titer in the human after receiving the first dose that is at least 2-fold higher than the toxin neutralizing titer in the human prior to receiving the first dose (e.g., higher than the toxin neutralizing titer in the human in the absence of the first dose), when measured under identical conditions in the cytotoxicity assay. In one embodiment, the composition induces a toxin neutralizing titer in the human that is at least 4-fold higher than the toxin neutralizing titer in the human prior to receiving the first dose, when measured under identical conditions in a cytotoxicity assay. In one embodiment, the composition induces a toxin neutralizing titer in the human that is at least 8-fold higher than the toxin neutralizing titer in the human prior to receiving the first dose, when measured under identical conditions in a cytotoxicity assay.

In one embodiment, the human has, for example, a toxin neutralizing titer equal to or greater than the lower limit of quantitation (LLOQ) of the cytotoxicity assay after administration of the first dose of the composition. In another embodiment, the human has, for example, a cytotoxicity assay titer equal to or greater than the LLOQ of the cytotoxicity assay after administration of the second dose of the composition. In another embodiment, the human has, for example, a toxin neutralizing titer equal to or greater than the LLOQ of the cytotoxicity assay after administration of the third dose of the composition.

In one embodiment, a primary immunogenicity endpoint is assessed based upon the ability of the vaccine to induce toxin A- and toxin B-specific neutralizing antibody levels greater than or equal to a specified threshold estimate for each *C. difficile* vaccine toxoid. For example, specified thresholds derived from a Phase 2 efficacy study demonstrating that passive administration of 2 mAbs against toxin A and toxin B were associated with protection against CDI may be used. In addition to showing efficacy of anti-toxin mAbs against recurrent CDI, the Phase 2 efficacy study also suggested that anti-toxin A- and anti-toxin B-neutralizing mAb levels above a threshold of 10 μg/mL ("protective" threshold level) were associated with protection against CDI recurrence.

In one embodiment, to translate the toxin A and toxin B "protective" threshold from the Phase 2 efficacy study into 50% neutralization titers elicited by the vaccine candidate, advantage is taken of the observations that (1) the same cytotoxicity assay is used to measure toxin neutralization and (2) the inhibitory mAb concentration that neutralizes 50% of the toxins ($IC_{50}$ [50% inhibitory concentration]) had been published ($IC_{50}$ values for the toxin A and toxin B mAbs are 100 ng/mL and 15 ng/mL, respectively). In one embodiment, the "protective" 50% neutralization titer for each anti-toxin antibody is, therefore, calculated to be the antibody concentration at the protective threshold of 10 μg/mL divided by the respective mAb $IC_{50}$.

For example, to qualify the 50% neutralization titer assay for clinical use, provide further robustness to the assay, and assure consistent long-term performance in clinical development, a reference standard and appropriate controls were added to the assay, thereby permitting the read out of a neutralization titer as neutralization units/mL defined by the reference standard. Prior to analysis of the current study, serum samples from vaccinated humans were used to demonstrate a linear relationship between 50% neutralization titers and neutralization units/mL when performing the neutralization assay. Based on these correlation studies, "protective" neutralization threshold values were calculated and used to analyze the clinical data in this study.

For the immunogenicity analyses, the "protective" thresholds for antitoxin A- and antitoxin B-neutralizing antibody responses were 219 and 2586 neutralization units/mL, respectively. Several of the immunogenicity endpoints for Study B5091009 were assessed based upon these "protective" thresholds.

In one embodiment, the "specified threshold" value is defined as 219 neutralization units/mL for toxin A and 2586 neutralization units/mL for toxin B.

Methods of Analysis. For any *C. difficile* toxin A- or toxin B-specific neutralizing antibody level that was below the lower limit of quantitation (LLOQ), the LOD, defined as 0.5×LLOQ, may be assigned. In one embodiment, the LLOQs for the toxin A- and toxin B-specific neutralization assays are 158.0 neutralization units/mL and 249.5 neutralization units/mL, respectively.

In one embodiment, if the toxin A—specific neutralizing antibody level is LLOQ for toxin—A, the subject is considered seropositive for toxin A. If the toxin B-specific neutralizing antibody level is LLOQ for toxin B, the subject is considered seropositive for toxin B. Conversely, if an antibody level is <LLOQ, the subject was considered seronegative.

Antibody or Antigen Binding Fragment thereof

In one aspect, the invention relates to an antibody including the amino acid sequence set forth in SEQ ID NO: 841, or an antigen binding fragment thereof. In another aspect, the invention relates to compositions including the antibody or antigen binding fragment thereof and methods of using the antibody or antigen binding fragment thereof. In one embodiment, the antibody or antigen binding fragment thereof includes an amino acid sequence that is about 60%, 65%, 70%, 75%, 80%, 85%, 86%, 87%, 88%, 89%, 90%, 91%, 92%, 93%, 94%, 95%, 96%, 97%, 98%, 99%, or 100% identical to SEQ ID NO: 841.

In one embodiment, the antibody or binding fragment thereof has a neutralizing effect on *C. difficile* toxins. The antibody or binding fragment thereof can neutralize *C. difficile* toxin cytotoxicity in vitro, inhibit binding of *C. difficile* toxin to mammalian cells, and/or can neutralize *C. difficile* toxin enterotoxicity in vivo. The present invention also relates to isolated polynucleotides that include nucleic acid sequences encoding the antibody or binding fragment thereof. In addition, the present invention relates to use of compositions comprising any of the foregoing antibodies or binding fragments thereof to treat, prevent, decrease the risk of, decrease severity of, decrease occurrences of, and/or delay the outset of a *C. difficile* infection, *C. difficile* associated disease, syndrome, condition, symptom, and/or complication thereof in a mammal, as compared to a mammal to which the composition is not administered, as well as methods for preparing said compositions.

The antibody molecules can be full-length (e.g., an IgG1 or IgG4 antibody). The antibodies can be of the various isotypes, including: IgG (e.g., IgG1, IgG2, IgG3, IgG4), IgM, IgA1, IgA2, IgD, or IgE. In one preferred embodiment, the antibody is an IgG isotype, e.g., IgG1. In another preferred embodiment, the antibody is an IgE antibody.

In another embodiment, the antibody molecule includes an "antigen-binding fragment" or "binding fragment," as used herein, which refers to a portion of an antibody that specifically binds to a toxin of C. difficile (e.g., toxin A). The binding fragment is, for example, a molecule in which one or more immunoglobulin chains is not full length, but which specifically binds to a toxin.

Examples of binding portions encompassed within the term "binding fragment" of an antibody include (i) a Fab fragment, a monovalent fragment consisting of the VL, VH, CL and CH1 domains; (ii) a F(ab') 2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., Nature 341: 544-546, 1989), which consists of a VH domain; and (vi) an isolated complementarity determining region (CDR) having sufficient framework to specifically bind, e.g., an antigen binding portion of a variable region.

As used herein, a "neutralizing antibody or binding fragment thereof refers to a respective antibody or binding fragment thereof that binds to a pathogen agent (e.g., a C. difficile TcdA or TcdB) and reduces the infectivity and/or an activity of the pathogen (e.g., reduces cytotoxicity) in a mammal and/or in cell culture, as compared to the pathogen under identical conditions in the absence of the neutralizing antibody or binding fragment thereof. In one embodiment, the neutralizing antibody or binding fragment thereof is capable of neutralizing at least about 70%, 75%, 80%, 85%, 90%, 95%, 99%, or more of a biological activity of the pathogen, as compared to the biological activity of the pathogen under identical conditions in the absence of the neutralizing antibody or binding fragment thereof.

As used herein, the term "anti-toxin antibody or binding fragment thereof refers to an antibody or binding fragment thereof that binds to the respective C. difficile toxin (e.g., a C. difficile toxin A or toxin B). For example, an anti-toxin A antibody or binding fragment thereof refers to an antibody or binding fragment thereof that binds to TcdA.

The anti-toxin antibody or binding fragment thereof can be administered in combination with other anti-C. difficile toxin antibodies (e.g., other monoclonal antibodies, polyclonal gamma-globulin) or a binding fragment thereof. Combinations that can be used include an anti-toxin A antibody or binding fragment thereof and an anti-toxin B antibody or binding fragment thereof.

It is understood that any of the inventive compositions, for example, an anti-toxin A and/or anti-toxin B antibody or binding fragment thereof, can be combined in different ratios or amounts for therapeutic effect. For example, the anti-toxin A and anti-toxin B antibody or respective binding fragment thereof can be present in a composition at a ratio in the range of 0.1:10 to 10:0.1, A:B. In another embodiment, the anti-toxin A and anti-toxin B antibody or respective binding fragment thereof can be present in a composition at a ratio in the range of 0.1:10 to 10:0.1, B:A.

Methods and Administration

In one aspect, the invention relates to a method of inducing an immune response against C. difficile in a human. In another aspect, the invention relates to a method of vaccinating a human. In one embodiment, the method includes administering to the human at least one dose of the composition described above. In a preferred embodiment, the method includes administering to the human at most one dose of the composition described above. In another embodiment, the method includes administering to the human a first dose and a second dose of the composition described above.

In one embodiment, the second dose is administered about 6 months after the first dose. In one embodiment, the second dose is administered at least 20, 30, 50, 60, 100, 120, 160, 170, or 180 days after the first dose, and at most 250, 210, 200, or 190 days after the first dose. Any minimum value may be combined with any maximum value described herein to define a range.

In another embodiment, the second dose is administered about 30 days after the first dose. In another embodiment, the second dose is administered about 60 days after the first dose, such as, for example, in a 0, 2 month immunization schedule. In another embodiment, the second dose is administered about 180 days after the first dose, such as, for example, in a 0, 6 month immunization schedule. In yet another embodiment, the second dose is administered about 120 days after the first dose, such as, for example, in a 2, 6 month immunization schedule.

In one embodiment, the method includes administering to the human two doses of the composition and at most two doses. In one embodiment, the two doses are administered within a period of about 6 months after the first dose. In one embodiment, the method does not include further administration of a booster to the human. A "booster" as used herein refers to an additional administration of the composition to the human. Administering to the human at most two doses of the composition may be advantageous. Such advantages include, for example, facilitating a human to comply with a complete administration schedule and facilitating cost-effectiveness of the schedule.

In one embodiment, the first dose and the second dose are administered to the human over a period of about 5 days, 7 days, 14 days, 21, 25, 30, 40, 50, 60, 70, 80, 90, 100, 110, 120, 130, 140, 150, 160, 170, 180, 190, or 200 days, and most 400, 390, 380, 370, 365, 350, 340, 330, 320, 310, 300, 290, 280, 270, 260, 250, 240, 230, 220, 210, or 200 days after the first dose. In one embodiment, the second dose is administered to the human at least 8, 14, 21, 25, or 30 days and at most 100, 90, 80, 70, 60, 50, 45, 40, 35, or 30 days after administration of the first dose. For example, in one embodiment, the second dose is administered to the human at least 21 days and at most 40 days after administration of the first dose. Any minimum value may be combined with any maximum value described herein to define a range. Preferably, the first dose and second dose are administered to the human over a period of about 8 days. More preferably, the first dose and second dose are administered to the human over a period of about 30 days. Most preferably, the first dose and second dose are administered to the human over a period of at least about 30 days.

In one embodiment, the first dose and the second dose are administered to the human over a period of about 30 days. In another embodiment, the first dose and the second dose are administered to the human over a period of about 60 days. In another embodiment, the first dose and the second dose are administered to the human over a period of about 180 days.

In one embodiment, the method includes administering to the human three doses of the composition. In another embodiment, the method includes administering at most three doses of the composition. In one embodiment, the three doses are administered within a period of about 6 months after the first dose. In one embodiment, the method includes an administration of a booster dose to the human after the third dose. In another embodiment, the method does not include administration of a booster dose to the human after the third dose. In another embodiment, the method does not further include administering a fourth or booster dose of the composition to the human. In a further embodiment, at most three doses within a period of about 6 months are administered to the human.

In an exemplary embodiment, the second dose is administered about 30 days after the first dose, and the third dose is administered about 150 to 180 days after the second dose, such as, for example, in a 0, 1, 6 month immunization schedule. In another exemplary embodiment, the second dose is administered about 60 days after the first dose, and the third dose is administered about 120 days after the second dose, such as, for example, in a 0, 2, 6 month immunization schedule.

In one embodiment, the first dose, second dose, and third dose are administered to the human over a period of about 150, 160, 170, or 180 days, and at most 240, 210 200, or 190 days. Any minimum value may be combined with any maximum value described herein to define a range. Preferably, the first dose, second dose, and third dose is administered to the human over a period of about 180 days or 6 months. For example, the second dose may be administered to the human about 60 days after the first dose, and the third dose may be administered to the human about 120 days after the second dose. Accordingly, an exemplary schedule of administration includes administering a dose to the human at about months 0, 2, and 6.

As described above, multiple doses of the immunogenic composition may be administered to the human, and the number of days between each dose may vary. An advantage of the method includes, for example, flexibility for a human to comply with the administration schedules.

In one aspect, the invention relates to a method of inducing an immune response in a mammal (preferably a human) against *C. difficile* expressing a toxin having any one amino acid sequence of SEQ ID Nos: 762-800. In another aspect, the invention relates to a method of inducing an immune response in a mammal (preferably a human) against *C. difficile* expressing a toxin having any one amino acid sequence of SEQ ID Nos: 801-840. In one embodiment, the method includes administering to the human at least one dose of the composition described above. In a preferred embodiment, the method includes administering to the human at most one dose of the composition described herein. In another embodiment, the method includes administering to the human at most two doses of the composition described herein.

In one embodiment, the method includes administering to the human a composition that includes a first polypeptide comprising the amino acid sequence SEQ ID NO: 4, wherein the methionine at position 1 is not present, and a second polypeptide comprising the amino acid sequence SEQ ID NO: 6, wherein the methionine at position 1 is not present. In another embodiment, the first and the second polypeptide are further chemically inactivated by EDC and NHS, as described, for example, in Example 21 of WIPO Patent Application WO/2012/143902, U.S. Pat. No. 9,187,536, and WIPO Patent Application WO/2014/060898, WIPO Patent Application WO/2012/143902, U.S. Pat. No. 9,187,536, and WIPO Patent Application WO/2014/060898, In one embodiment, the method includes administering to the human a composition that includes a polypeptide comprising any one of the amino acid sequences described in FIG. 7. In another embodiment, the method includes administering to the human a composition that includes a polypeptide comprising any one of the amino acid sequences described in FIG. 8. In another embodiment, the method includes administering to the human a composition that includes a first polypeptide comprising any one of the amino acid sequences described in FIG. 7; and a second polypeptide comprising any one of the amino acid sequences described in FIG. 8.

Doses

In one embodiment, the method includes administering to the human three doses of the composition. In another embodiment, the method includes administering at most three doses of the composition. In one embodiment, the three doses are administered within a period of about 6 months after the first dose. In one embodiment, the method includes an administration of a booster dose to the human after the third dose. In another embodiment, the method does not include administration of a booster dose to the human after the third dose. In another embodiment, the method does not further include administering a fourth or booster dose of the composition to the human. In a further embodiment, at most three doses within a period of about 6 months are administered to the human.

In an exemplary embodiment, the second dose is administered about 30 days after the first dose, and the third dose is administered about 150 to 180 days after the second dose, such as, for example, in a 0, 1, 6 month immunization schedule. In another exemplary embodiment, the second dose is administered about 60 days after the first dose, and the third dose is administered about 120 days after the second dose, such as, for example, in a 0, 2, 6 month immunization schedule.

In one embodiment, the first dose, second dose, and third dose are administered to the human over a period of about 150, 160, 170, or 180 days, and at most 240, 210 200, or 190 days. Any minimum value may be combined with any maximum value described herein to define a range. Preferably, the first dose, second dose, and third dose is administered to the human over a period of about 180 days or 6 months. For example, the second dose may be administered to the human about 60 days after the first dose, and the third dose may be administered to the human about 120 days after the second dose. Accordingly, an exemplary schedule of administration includes administering a dose to the human at about months 0, 2, and 6.

As described above, multiple doses of the immunogenic composition may be administered to the human, and the number of days between each dose may vary. An advantage of the method includes, for example, flexibility for a human to comply with the administration schedules.

In one embodiment, the method includes administering to the human at most three doses of the identical immunogenic composition. For example, in a preferred embodiment, the method does not include administering to the human a first dose of a first composition, administering to the human a second dose of a second composition, and administering to the human a third dose of a third composition, wherein the first, second, and third compositions are not identical. In another embodiment, the method includes administering to the human at most four doses of the identical immunogenic composition.

Antibodies

In one aspect, an immunogenic composition is capable of binding to a neutralizing antibody or binding fragment thereof. Preferably, the neutralizing antibody or binding fragment thereof is one described herein below. In one exemplary embodiment, an immunogenic composition is capable of binding to an anti-toxin A antibody or binding fragment thereof, wherein the anti-toxin A antibody or binding fragment thereof has any one of the amino acid sequences set forth in SEQ ID NO: 1014-1015. For example, the immunogenic composition may include a mutant C. difficile TcdA polypeptide having the amino acid sequence selected from any one of SEQ ID NO: 1, 15, 17, 19, 87, 88-109, 134-140, 148-157, 168-172, 178, and 180, wherein the polypeptide is crosslinked. As another example, the immunogenic composition may include a mutant C. difficile TcdA having the amino acid sequence selected from any one of SEQ ID NO: 3, 4, 7, 28, 29, 32, 34, 36, 83, 84, 183, 196-212, 223-245, 250-253, 255-263, 276-323, 374-421, 472-567, 664-711, and 185-195, wherein the polypeptide may be optionally crosslinked In another exemplary embodiment, an immunogenic composition is capable of binding to an anti-toxin B antibody or binding fragment thereof, wherein the anti-toxin B antibody or binding fragment thereof has any one of the amino acid sequences set forth in SEQ ID NO: 1010-1015:1015. As another example, the immunogenic composition may include SEQ ID NO: 86 or SEQ ID NO: 85. For example, the immunogenic composition may include a mutant C. difficile Tcd B polypeptide having the amino acid sequence selected from any one of SEQ ID NO: 2, 21, 23, 25, 110-133, 141-167, 173-179, 181, and 182, wherein the polypeptide is crosslinked. As another example, the immunogenic composition may include a mutant C. difficile Tcd B having the amino acid sequence selected from any one of SEQ ID NO: 5, 6, 8, 30, 31, 33, 35, 82, 85, 86, 184, 213-222, 246-249, 264-269, 324-373, 422-471, 568-663, 712-761, and 185-195, wherein the polypeptide may be optionally crosslinked, such crosslinked by formaldehyde, EDC, NHS, or a combination of EDC and NHS.

The inventive immunogenic compositions described above elicited novel antibodies in vivo, suggesting that the immunogenic compositions include a preserved native structure (e.g., a preserved antigenic epitope) of the respective wild-type C. difficile toxin and that the immunogenic compositions include an epitope. The antibodies produced against a toxin from one strain of C. difficile may be capable of binding to a corresponding toxin produced by another strain of C. difficile. That is, the antibodies and binding fragments thereof may by "cross-reactive," which refers to the ability to react with similar antigenic sites on toxins produced from multiple C. difficile strains. Cross-reactivity also includes the ability of an antibody to react with or bind an antigen that did not stimulate its production, i.e., the reaction between an antigen and an antibody that was generated against a different but similar antigen.

In one aspect, the inventors surprisingly discovered monoclonal antibodies having a potentially neutralizing effect on C. difficile toxins, and methods of producing the same. The inventive antibodies can neutralize C. difficile toxin cytotoxicity in vitro, inhibit binding of C. difficile toxin to mammalian cells, and/or can neutralize C. difficile toxin enterotoxicity in vivo. The present invention also relates to isolated polynucleotides that include nucleic acid sequences encoding any of the foregoing. In addition, the present invention relates to use of any of the foregoing compositions to treat, prevent, decrease the risk of, decrease severity of, decrease occurrences of, and/or delay the outset of a C. difficile infection, C. difficile associated disease, syndrome, condition, symptom, and/or complication thereof in a mammal, as compared to a mammal to which the composition is not administered, as well as methods for preparing said compositions.

The inventors further discovered that a combination of at least two of the neutralizing monoclonal antibodies can exhibit an unexpectedly synergistic effect in respective neutralization of TcdA or TcdB. Anti-toxin antibodies or binding fragments thereof can be useful in the inhibition of a C. difficile infection.

An "antibody" is a protein including at least one or two heavy (H) chain variable regions (abbreviated herein as VH), and at least one or two light (L) chain variable regions (abbreviated herein as VL). The VH and VL regions can be further subdivided into regions of hypervariability, termed "complementarity determining regions" ("CDR"), interspersed with regions that are more conserved, termed "framework regions" (FR). The extent of the framework region and CDRs has been precisely defined (see, Kabat, E. A., et al. Sequences of Proteins of Immunological Interest, Fifth Edition, U.S. Department of Health and Human Services, NIH Publication No. 91-3242, 1991, and Chothia, C. et al., J. Mol. Biol. 196:901-917, 1987). The term "antibody" includes intact immunoglobulins of types IgA, IgG, IgE, IgD, IgM (as well as subtypes thereof), wherein the light chains of the immunoglobulin may be of types kappa or lambda.

The antibody molecules can be full-length (e.g., an IgG1 or IgG4 antibody). The antibodies can be of the various isotypes, including: IgG (e.g., IgG1, IgG2, IgG3, IgG4), IgM, IgA1, IgA2, IgD, or IgE. In one preferred embodiment, the antibody is an IgG isotype, e.g., IgG1. In another preferred embodiment, the antibody is an IgE antibody.

In another embodiment, the antibody molecule includes an "antigen-binding fragment" or "binding fragment," as used herein, which refers to a portion of an antibody that specifically binds to a toxin of C. difficile (e.g., toxin A). The binding fragment is, for example, a molecule in which one or more immunoglobulin chains is not full length, but which specifically binds to a toxin.

Examples of binding portions encompassed within the term "binding fragment" of an antibody include (i) a Fab fragment, a monovalent fragment consisting of the VL, VH, CL and CH1 domains; (ii) a F(ab) 2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., Nature 341:544-546, 1989), which consists of a VH domain; and (vi) an isolated complementarity determining region (CDR) having sufficient framework to specifically bind, e.g., an antigen binding portion of a variable region.

A binding fragment of a light chain variable region and a binding fragment of a heavy chain variable region, e.g., the two domains of the Fv fragment, VL and VH, can be joined, using recombinant methods, by a synthetic linker that enables them to be made as a single protein chain in which the VL and VH regions pair to form monovalent molecules (known as single chain Fv (scFv); see e.g., Bird et al. (1988) Science 242:423-426; and Huston et al. (1988) Proc. Natl. Acad. Sci. USA 85:5879-5883). Such single chain antibodies are also encompassed within the term "binding fragment" of an antibody. These antibody portions are obtained using techniques known in the art, and the portions are screened for utility in the same manner as are intact antibodies.

As used herein, an antibody that "specifically binds" to or is "specific" for a particular polypeptide or an epitope on a particular polypeptide is an antibody that binds to that particular polypeptide or epitope on a particular polypeptide without substantially binding to any other polypeptide or polypeptide epitope. For example, when referring to a biomolecule (e.g., protein, nucleic acid, antibody, etc.) that "specifically binds" to a target, the biomolecule binds to its target molecule and does not bind in a significant amount to other molecules in a heterogeneous population of molecules that include the target, as measured under designated conditions (e.g. immunoassay conditions in the case of an antibody). The binding reaction between the antibody and its target is determinative of the presence of the target in the heterogeneous population of molecules. For example, "specific binding" or "specifically binds" refers to the ability of an antibody or binding fragment thereof to bind to a wild-type and/or mutant toxin of *C. difficile* with an affinity that is at least two-fold greater than its affinity for a non-specific antigen.

In an exemplary embodiment, the antibody is a chimeric antibody. A chimeric antibody can be produced by recombinant DNA techniques known in the art. For example, a gene encoding the Fc constant region of a murine (or other species) monoclonal antibody molecule can be digested with restriction enzymes to remove the region encoding the murine Fc, and the equivalent portion of a gene encoding a human Fc constant region is substituted. A chimeric antibody can also be created by recombinant DNA techniques where DNA encoding murine variable regions can be ligated to DNA encoding the human constant regions.

In another exemplary embodiment, the antibody or binding fragment thereof is humanized by methods known in the art. For example, once murine antibodies are obtained, a CDR of the antibody may be replaced with at least a portion of a human CDR. Humanized antibodies can also be generated by replacing sequences of the murine Fv variable region that are not directly involved in antigen binding with equivalent sequences from human Fv variable regions. General methods for generating humanized antibodies are known in the art.

For example, monoclonal antibodies directed toward *C. difficile* TcdA or *C. difficile* TcdB can also be produced by standard techniques, such as a hybridoma technique (see, e.g., Kohler and Milstein, 1975, *Nature*, 256: 495-497). Briefly, an immortal cell line is fused to a lymphocyte from a mammal immunized with *C. difficile* TcdA, *C. difficile* TcdB, or a mutant *C. difficile* toxin described herein, and the culture supernatants of the resulting hybridoma cells are screened to identify a hybridoma producing a monoclonal antibody that binds to *C. difficile* TcdA or *C. difficile* TcdB. Typically, the immortal cell line is derived from the same mammalian species as the lymphocytes. Hybridoma cells producing a monoclonal antibody of the invention are detected by screening the hybridoma culture supernatants for antibodies that bind *C. difficile* TcdA or *C. difficile* TcdB using an assay, such as ELISA. Human hybridomas can be prepared in a similar way.

As an alternative to producing antibodies by immunization and selection, antibodies of the invention may also be identified by screening a recombinant combinatorial immunoglobulin library with a *C. difficile* TcdA, *C. difficile* TcdB, or a mutant *C. difficile* toxin described herein. The recombinant antibody library may be an scFv library or an Fab library, for example. Moreover, the inventive antibodies described herein may be used in competitive binding studies to identify additional anti-TcdA or anti-TcdB antibodies and binding fragments thereof. For example, additional anti-TcdA or anti-TcdB antibodies and binding fragments thereof may be identified by screening a human antibody library and identifying molecules within the library that competes with the inventive antibodies described herein in a competitive binding assay.

In addition, antibodies encompassed by the present invention include recombinant antibodies that may be generated by using phage display methods known in the art. In phage display methods, phage can be used to display antigen binding domains expressed from a repertoire or antibody library (e.g., human or murine). Phage expressing an antigen binding domain that binds to an immunogen described herein (e.g., a mutant *C. difficile* toxin) can be selected or identified with antigen, e.g., using labeled antigen.

Also within the scope of the invention are antibodies and binding fragments thereof in which specific amino acids have been substituted, deleted, or added. In particular, preferred antibodies have amino acid substitutions in the framework region, such as to improve binding to the antigen. For example, a selected, small number of acceptor framework residues of the immunoglobulin chain can be replaced by the corresponding donor amino acids. Preferred locations of the substitutions include amino acid residues adjacent to the CDR, or which are capable of interacting with a CDR. Criteria for selecting amino acids from the donor are described in U.S. Pat. No. 5,585,089 (e.g., columns 12-16). The acceptor framework can be a mature human antibody framework sequence or a consensus sequence.

As used herein, a "neutralizing antibody or binding fragment thereof" refers to a respective antibody or binding fragment thereof that binds to a pathogen (e.g., a *C. difficile* TcdA or TcdB) and reduces the infectivity and/or an activity of the pathogen (e.g., reduces cytotoxicity) in a mammal and/or in cell culture, as compared to the pathogen under identical conditions in the absence of the neutralizing antibody or binding fragment thereof. In one embodiment, the neutralizing antibody or binding fragment thereof is capable of neutralizing at least about 70%, 75%, 80%, 85%, 90%, 95%, 99%, or more of a biological activity of the pathogen, as compared to the biological activity of the pathogen under identical conditions in the absence of the neutralizing antibody or binding fragment thereof.

As used herein, the term "anti-toxin antibody or binding fragment thereof" refers to an antibody or binding fragment thereof that binds to the respective *C. difficile* toxin (e.g., a *C. difficile* toxin A or toxin B). For example, an anti-toxin A antibody or binding fragment thereof refers to an antibody or binding fragment thereof that binds to TcdA. The antibodies or binding fragments thereof described herein may be raised in any mammal, wild-type and/or transgenic, including, for example, mice, humans, rabbits, and goats.

When an immunogenic composition described above is one that has been previously administered to a population, such as for vaccination, the antibody response generated in the subjects can be used to neutralize toxins from the same strain and from a strain that did not stimulate production of the antibody. See, for example, Example 37, which shows studies relating to cross-reactivity, generated by the immunogenic composition, between the 630 strain and toxins from various wild-type *C. difficile* strains.

In one aspect, the invention relates to an antibody or binding fragment thereof specific to *C. difficile* TcdA. Monoclonal antibodies that specifically bind to TcdA include an antibody or binding fragment thereof having any one of the amino acid sequences set forth in SEQ ID NO: 888-1009. In some embodiments, the antibody or binding fragment thereof has the amino acid sequence set forth in SEQ ID NO: 888 and a light chain variable region having the amino acid sequence set forth in SEQ ID NO: 889.

In some embodiments, the antibody or binding fragment thereof has a heavy variable region having the amino acid sequence set forth in SEQ ID NO: 890 and a light chain variable region having the amino acid sequence set forth in SEQ ID NO: 891. In some embodiments, the antibody or binding fragment thereof binds to an epitope of C. difficile toxoid A, wherein the epitope comprises the amino acid sequence set forth in any one of SEQ ID NO: 1016-SEQ ID NO: 1018. In some embodiments, the antibody or binding fragment thereof binds to an epitope of C. difficile toxin A, wherein the epitope comprises the amino acid sequence set forth in any one of SEQ ID NO: 1016-SEQ ID NO: 1018.

In some embodiments, the antibody or binding fragment thereof has a heavy variable region having the amino acid sequence set forth in SEQ ID NO: 892 and a light chain variable region having the amino acid sequence set forth in SEQ ID NO: 893. In some embodiments, the antibody or binding fragment thereof binds to an epitope of C. difficile toxoid A, wherein the epitope comprises the amino acid sequence set forth in any one of SEQ ID NO: 1019 and SEQ ID NO: 1020. In some embodiments, the antibody or binding fragment thereof binds to an epitope of C. difficile toxin A, wherein the epitope comprises the amino acid sequence set forth in any one of SEQ ID NO: 1019 and SEQ ID NO: 1020.

In some embodiments, the antibody or binding fragment thereof has a heavy variable region having the amino acid sequence set forth in SEQ ID NO: 894 and a light chain variable region having the amino acid sequence set forth in SEQ ID NO: 895. In some embodiments, the antibody or binding fragment thereof binds to an epitope of C. difficile toxoid A, wherein the epitope comprises the amino acid sequence set forth in any one of SEQ ID NO: 1021 and SEQ ID NO: 1022. In some embodiments, the antibody or binding fragment thereof binds to an epitope of C. difficile toxin A, wherein the epitope comprises the amino acid sequence set forth in any one of SEQ ID NO: 1021 and SEQ ID NO: 1022.

In some embodiments, the antibody or binding fragment thereof has a heavy variable region having the amino acid sequence set forth in SEQ ID NO: 896 and a light chain variable region having the amino acid sequence set forth in SEQ ID NO: 897.

In some embodiments, the antibody or binding fragment thereof has a heavy variable region having the amino acid sequence set forth in SEQ ID NO: 898 and a light chain variable region having the amino acid sequence set forth in SEQ ID NO: 899. In some embodiments, the antibody or binding fragment thereof binds to an epitope of C. difficile toxoid A, wherein the epitope comprises the amino acid sequence set forth in SEQ ID NO: 1023. In some embodiments, the antibody or binding fragment thereof binds to an epitope of C. difficile toxin A, wherein the epitope comprises the amino acid sequence set forth in SEQ ID NO: 1023.

In some embodiments, the antibody or binding fragment thereof has a heavy variable region having the amino acid sequence set forth in SEQ ID NO: 900 and a light chain variable region having the amino acid sequence set forth in SEQ ID NO: 901. In some embodiments, the antibody or binding fragment thereof binds to an epitope of C. difficile toxoid A, wherein the epitope comprises the amino acid sequence set forth in SEQ ID NO: 1024. In some embodiments, the antibody or binding fragment thereof binds to an epitope of C. difficile toxin A, wherein the epitope comprises the amino acid sequence set forth in SEQ ID NO: 1024.

In some embodiments, the antibody or binding fragment thereof has a heavy variable region having the amino acid sequence set forth in SEQ ID NO: 902 and a light chain variable region having the amino acid sequence set forth in SEQ ID NO: 903. In some embodiments, the antibody or binding fragment thereof binds to an epitope of C. difficile toxoid A, wherein the epitope comprises the amino acid sequence set forth in SEQ ID NO: 1025. In some embodiments, the antibody or binding fragment thereof binds to an epitope of C. difficile toxin A, wherein the epitope comprises the amino acid sequence set forth in SEQ ID NO: 1025.

In some embodiments, the antibody or binding fragment thereof has a heavy variable region having the amino acid sequence set forth in SEQ ID NO: 904 and a light chain variable region having the amino acid sequence set forth in SEQ ID NO: 905. In some embodiments, the antibody or binding fragment thereof binds to an epitope of C. difficile toxoid A, wherein the epitope comprises the amino acid sequence set forth in SEQ ID NO: 1026. In some embodiments, the antibody or binding fragment thereof binds to an epitope of C. difficile toxin A, wherein the epitope comprises the amino acid sequence set forth in SEQ ID NO: 1026.

In some embodiments, the antibody or binding fragment thereof has a heavy variable region having the amino acid sequence set forth in SEQ ID NO: 906 and a light chain variable region having the amino acid sequence set forth in SEQ ID NO: 907.

In some embodiments, the antibody or binding fragment thereof has a heavy variable region having the amino acid sequence set forth in SEQ ID NO: 908 and a light chain variable region having the amino acid sequence set forth in SEQ ID NO: 909. In some embodiments, the antibody or binding fragment thereof binds to an epitope of C. difficile toxoid A, wherein the epitope comprises the amino acid sequence set forth in SEQ ID NO: 1027. In some embodiments, the antibody or binding fragment thereof binds to an epitope of C. difficile toxin A, wherein the epitope comprises the amino acid sequence set forth in SEQ ID NO: 1027.

In some embodiments, the antibody or binding fragment thereof has a heavy variable region having the amino acid sequence set forth in SEQ ID NO: 910 and a light chain variable region having the amino acid sequence set forth in SEQ ID NO: 911. In some embodiments, the antibody or binding fragment thereof binds to an epitope of C. difficile toxoid A, wherein the epitope comprises the amino acid sequence set forth in SEQ ID NO: 1028. In some embodiments, the antibody or binding fragment thereof binds to an epitope of C. difficile toxin A, wherein the epitope comprises the amino acid sequence set forth in SEQ ID NO: 1028.

In some embodiments, the antibody or binding fragment thereof has a heavy variable region having the amino acid sequence set forth in SEQ ID NO: 912 and a light chain variable region having the amino acid sequence set forth in SEQ ID NO: 913. In some embodiments, the antibody or binding fragment thereof binds to an epitope of C. difficile toxoid A, wherein the epitope comprises the amino acid sequence set forth in SEQ ID NO: 1029. In some embodiments, the antibody or binding fragment thereof binds to an epitope of C. difficile toxin A, wherein the epitope comprises the amino acid sequence set forth in SEQ ID NO: 1029.

In some embodiments, the antibody or binding fragment thereof has a heavy variable region having the amino acid sequence set forth in SEQ ID NO: 914 and a light chain variable region having the amino acid sequence set forth in SEQ ID NO: 915. In some embodiments, the antibody or binding fragment thereof binds to an epitope of *C. difficile* toxoid A, wherein the epitope comprises the amino acid sequence set forth in any one of SEQ ID NO: 1030 and SEQ ID NO: 1031. In some embodiments, wherein the antibody or binding fragment thereof binds to an epitope of *C. difficile* toxin A, wherein the epitope comprises the amino acid sequence set forth in any one of SEQ ID NO: 1030 and SEQ ID NO: 1031.

In some embodiments, the antibody or binding fragment thereof has a heavy variable region having the amino acid sequence set forth in SEQ ID NO: 916 and a light chain variable region having the amino acid sequence set forth in SEQ ID NO: 917. In some embodiments, the antibody or binding fragment thereof binds to an epitope of *C. difficile* toxoid A, wherein the epitope comprises the amino acid sequence set forth in any one of SEQ ID NO: 1032-SEQ ID NO: 1034. In some embodiments, the antibody or binding fragment thereof binds to an epitope of *C. difficile* toxin A, wherein the epitope comprises the amino acid sequence set forth in any one of SEQ ID NO: 1032-SEQ ID NO: 1034.

In some embodiments, the antibody or binding fragment thereof has a heavy variable region having the amino acid sequence set forth in SEQ ID NO: 918 and a light chain variable region having the amino acid sequence set forth in SEQ ID NO: 919. In some embodiments, in the antibody or binding fragment thereof binds to an epitope of *C. difficile* toxoid A, wherein the epitope comprises the amino acid sequence set forth in any one of SEQ ID NO: 1035 and SEQ ID NO: 1036. In some embodiments, the antibody or binding fragment thereof binds to an epitope of *C. difficile* toxin A, wherein the epitope comprises the amino acid sequence set forth in any one of SEQ ID NO: 1035 and SEQ ID NO: 1036.

In some embodiments, the antibody or binding fragment thereof has a heavy variable region having the amino acid sequence set forth in SEQ ID NO: 920 and a light chain variable region having the amino acid sequence set forth in SEQ ID NO: 921. In some embodiments, the antibody or binding fragment thereof binds to an epitope of *C. difficile* toxoid A, wherein the epitope comprises the amino acid sequence set forth in any one of SEQ ID NO: 1037 and SEQ ID NO: 1038. In some embodiments, the antibody or binding fragment thereof binds to an epitope of *C. difficile* toxin A, wherein the epitope comprises the amino acid sequence set forth in any one of SEQ ID NO: 1037 and SEQ ID NO: 1038.

In some embodiments, the antibody or binding fragment thereof has a heavy variable region having the amino acid sequence set forth in SEQ ID NO: 922 and a light chain variable region having the amino acid sequence set forth in SEQ ID NO: 923.

In some embodiments, the antibody or binding fragment thereof has a heavy variable region having the amino acid sequence set forth in SEQ ID NO: 924 and a light chain variable region having the amino acid sequence set forth in SEQ ID NO: 925.

In some embodiments, the antibody or binding fragment thereof has a heavy variable region having the amino acid sequence set forth in SEQ ID NO: 926 and a light chain variable region having the amino acid sequence set forth in SEQ ID NO: 927.

In some embodiments, the antibody or binding fragment thereof has a heavy variable region having the amino acid sequence set forth in SEQ ID NO: 928 and a light chain variable region having the amino acid sequence set forth in SEQ ID NO: 929.

In some embodiments, the antibody or binding fragment thereof has a heavy variable region having the amino acid sequence set forth in SEQ ID NO: 930 and a light chain variable region having the amino acid sequence set forth in SEQ ID NO: 931.

In some embodiments, the antibody or binding fragment thereof has a heavy variable region having the amino acid sequence set forth in SEQ ID NO: 932 and a light chain variable region having the amino acid sequence set forth in SEQ ID NO: 933. In some embodiments, the antibody or binding fragment thereof binds to an epitope of *C. difficile* toxoid A, wherein the epitope comprises the amino acid sequence set forth in SEQ ID NO: 1039. In some embodiments, the antibody or binding fragment thereof binds to an epitope of *C. difficile* toxin A, wherein the epitope comprises the amino acid sequence set forth in SEQ ID NO: 1039.

In some embodiments, the antibody or binding fragment thereof has a heavy variable region having the amino acid sequence set forth in SEQ ID NO: 934 and a light chain variable region having the amino acid sequence set forth in SEQ ID NO: 935. In some embodiments, the antibody or binding fragment thereof binds to an epitope of *C. difficile* toxoid A, wherein the epitope comprises the amino acid sequence set forth in any one of SEQ ID NO: 1040 and SEQ ID NO: 1041. In some embodiments, the antibody or binding fragment thereof binds to an epitope of *C. difficile* toxin A, wherein the epitope comprises the amino acid sequence set forth in any one of SEQ ID NO: 1040 and SEQ ID NO: 1041.

In some embodiments, the antibody or binding fragment thereof has a heavy variable region having the amino acid sequence set forth in SEQ ID NO: 936 and a light chain variable region having the amino acid sequence set forth in SEQ ID NO: 937. the antibody or binding fragment thereof binds to an epitope of *C. difficile* toxoid A, wherein the epitope comprises the amino acid sequence set forth in any one of SEQ ID NO: 1042 and SEQ ID NO: 1043. In some embodiments, the antibody or binding fragment thereof binds to an epitope of *C. difficile* toxin A, wherein the epitope comprises the amino acid sequence set forth in any one of SEQ ID NO: 1042 and SEQ ID NO: 1043.

In some embodiments, the antibody or binding fragment thereof has a heavy variable region having the amino acid sequence set forth in SEQ ID NO: 938 and a light chain variable region having the amino acid sequence set forth in SEQ ID NO: 939. In some embodiments, the antibody or binding fragment thereof binds to an epitope of *C. difficile* toxoid A, wherein the epitope comprises the amino acid sequence set forth in any one of SEQ ID NO: 1044 and SEQ ID NO: 1045. In some embodiments, the antibody or binding fragment thereof binds to an epitope of *C. difficile* toxin A, wherein the epitope comprises the amino acid sequence set forth in any one of SEQ ID NO: 1044 and SEQ ID NO: 1045.

In some embodiments, the antibody or binding fragment thereof has a heavy variable region having the amino acid sequence set forth in SEQ ID NO: 940 and a light chain variable region having the amino acid sequence set forth in SEQ ID NO: 941. In some embodiments, the antibody or binding fragment thereof binds to an epitope of *C. difficile* toxoid A, wherein the epitope comprises the amino acid sequence set forth in any one of SEQ ID NO: 1046 and SEQ ID NO: 1047. In some embodiments, the antibody or binding fragment thereof binds to an epitope of *C. difficile* toxin A, wherein the epitope comprises the amino acid sequence set forth in any one of SEQ ID NO: 1046 and SEQ ID NO: 1047.

In some embodiments, the antibody or binding fragment thereof has a heavy variable region having the amino acid sequence set forth in SEQ ID NO: 942 and a light chain variable region having the amino acid sequence set forth in SEQ ID NO: 943. In some embodiments, the antibody or binding fragment thereof binds to an epitope of *C. difficile* toxoid A, wherein the epitope comprises the amino acid sequence set forth in SEQ ID NO: 1048. In some embodiments, the antibody or binding fragment thereof binds to an epitope of *C. difficile* toxin A, wherein the epitope comprises the amino acid sequence set forth in SEQ ID NO: 1048.

In some embodiments, the antibody or binding fragment thereof has a heavy variable region having the amino acid sequence set forth in SEQ ID NO: 944 and a light chain variable region having the amino acid sequence set forth in SEQ ID NO: 945. In some embodiments, in the antibody or binding fragment thereof binds to an epitope of *C. difficile* toxoid A, wherein the epitope comprises the amino acid sequence set forth in any one of SEQ ID NO: 1049-SEQ ID NO: 1052. In some embodiments, the antibody or binding fragment thereof binds to an epitope of *C. difficile* toxin A, wherein the epitope comprises the amino acid sequence set forth in any one of SEQ ID NO: 1049-SEQ ID NO: 1052.

In some embodiments, the antibody or binding fragment thereof has a heavy variable region having the amino acid sequence set forth in SEQ ID NO: 946 and a light chain variable region having the amino acid sequence set forth in SEQ ID NO: 947. In some embodiments, the antibody or binding fragment thereof binds to an epitope of *C. difficile* toxoid A, wherein the epitope comprises the amino acid sequence set forth in any one of SEQ ID NO: 1053 and SEQ ID NO: 1054. In some embodiments, the antibody or binding fragment thereof binds to an epitope of *C. difficile* toxin A, wherein the epitope comprises the amino acid sequence set forth in any one of SEQ ID NO: 1053 and SEQ ID NO: 1054.

In some embodiments, the antibody or binding fragment thereof has a heavy variable region having the amino acid sequence set forth in SEQ ID NO: 948 and a light chain variable region having the amino acid sequence set forth in SEQ ID NO: 949.

In some embodiments, the antibody or binding fragment thereof has a heavy variable region having the amino acid sequence set forth in SEQ ID NO: 950 and a light chain variable region having the amino acid sequence set forth in SEQ ID NO: 951. In some embodiments, the antibody or binding fragment thereof binds to an epitope of *C. difficile* toxoid A, wherein the epitope comprises the amino acid sequence set forth in any one of SEQ ID NO: 1055 and SEQ ID NO: 1056. In some embodiments, the antibody or binding fragment thereof binds to an epitope of *C. difficile* toxin A, wherein the epitope comprises the amino acid sequence set forth in any one of SEQ ID NO: 1055 and SEQ ID NO: 1056.

In some embodiments, the antibody or binding fragment thereof has a heavy variable region having the amino acid sequence set forth in SEQ ID NO: 952 and a light chain variable region having the amino acid sequence set forth in SEQ ID NO: 953. In some embodiments, the antibody or binding fragment thereof binds to an epitope of *C. difficile* toxoid A, wherein the epitope comprises the amino acid sequence set forth in any one of SEQ ID NO: 1057 and SEQ ID NO: 1058. In some embodiments, the antibody or binding fragment thereof binds to an epitope of *C. difficile* toxin A, wherein the epitope comprises the amino acid sequence set forth in any one of SEQ ID NO: 1057 and SEQ ID NO: 1058.

In some embodiments, the antibody or binding fragment thereof has a heavy variable region having the amino acid sequence set forth in SEQ ID NO: 954 and a light chain variable region having the amino acid sequence set forth in SEQ ID NO: 955. In some embodiments, the antibody or binding fragment thereof binds to an epitope of *C. difficile* toxoid A, wherein the epitope comprises the amino acid sequence set forth in SEQ ID NO: 1059. In some embodiments, the antibody or binding fragment thereof binds to an epitope of *C. difficile* toxin A, wherein the epitope comprises the amino acid sequence set forth in SEQ ID NO: 1059.

In some embodiments, the antibody or binding fragment thereof has a heavy variable region having the amino acid sequence set forth in SEQ ID NO: 956 and a light chain variable region having the amino acid sequence set forth in SEQ ID NO: 957. In some embodiments, the antibody or binding fragment thereof binds to an epitope of *C. difficile* toxoid A, wherein the epitope comprises the amino acid sequence set forth in SEQ ID NO: 1060. In some embodiments, the antibody or binding fragment thereof binds to an epitope of *C. difficile* toxin A, wherein the epitope comprises the amino acid sequence set forth in SEQ ID NO: 1060.

In some embodiments, the antibody or binding fragment thereof has a heavy variable region having the amino acid sequence set forth in SEQ ID NO: 958 and a light chain variable region having the amino acid sequence set forth in SEQ ID NO: 959. In some embodiments, the antibody or binding fragment thereof binds to an epitope of *C. difficile* toxoid A, wherein the epitope comprises the amino acid sequence set forth in SEQ ID NO: 1061. In some embodiments, the antibody or binding fragment thereof binds to an epitope of *C. difficile* toxin A, wherein the epitope comprises the amino acid sequence set forth in SEQ ID NO: 1061.

In some embodiments, the antibody or binding fragment thereof has a heavy variable region having the amino acid sequence set forth in SEQ ID NO: 960 and a light chain variable region having the amino acid sequence set forth in SEQ ID NO: 961. In some embodiments, the antibody or binding fragment thereof binds to an epitope of *C. difficile* toxoid A, wherein the epitope comprises the amino acid sequence set forth in SEQ ID NO: 1062. In some embodiments, the antibody or binding fragment thereof binds to an epitope of *C. difficile* toxin A, wherein the epitope comprises the amino acid sequence set forth in SEQ ID NO: 1062.

In some embodiments, the antibody or binding fragment thereof has a heavy variable region having the amino acid sequence set forth in SEQ ID NO: 962 and a light chain variable region having the amino acid sequence set forth in SEQ ID NO: 963. In some embodiments, the antibody or binding fragment thereof binds to an epitope of *C. difficile* toxoid A, wherein the epitope comprises the amino acid sequence set forth in any one of SEQ ID NO: 1063 and SEQ ID NO: 1064. In some embodiments, the antibody or binding fragment thereof binds to an epitope of *C. difficile* toxin A, wherein the epitope comprises the amino acid sequence set forth in any one of SEQ ID NO: 1063 and SEQ ID NO: 1064.

In some embodiments, the antibody or binding fragment thereof has a heavy variable region having the amino acid sequence set forth in SEQ ID NO: 964 and a light chain variable region having the amino acid sequence set forth in SEQ ID NO: 965. In some embodiments, the antibody or binding fragment thereof binds to an epitope of *C. difficile* toxoid A, wherein the epitope comprises the amino acid sequence set forth in any one of SEQ ID NO: 1065 and SEQ ID NO: 1066. In some embodiments, the antibody or binding fragment thereof binds to an epitope of *C. difficile* toxin A, wherein the epitope comprises the amino acid sequence set forth in any one of SEQ ID NO: 1065 and SEQ ID NO: 1066.

In some embodiments, the antibody or binding fragment thereof has a heavy variable region having the amino acid sequence set forth in SEQ ID NO: 966 and a light chain variable region having the amino acid sequence set forth in SEQ ID NO: 967.

In some embodiments, the antibody or binding fragment thereof has a heavy variable region having the amino acid sequence set forth in SEQ ID NO: 968 and a light chain variable region having the amino acid sequence set forth in SEQ ID NO: 969.

In some embodiments, the antibody or binding fragment thereof has a heavy variable region having the amino acid sequence set forth in SEQ ID NO: 970 and a light chain variable region having the amino acid sequence set forth in SEQ ID NO: 971. In some embodiments, the antibody or binding fragment thereof binds to an epitope of *C. difficile* toxoid A, wherein the epitope comprises the amino acid sequence set forth in any one of SEQ ID NO: 1067 and SEQ ID NO: 1068. In some embodiments, the antibody or binding fragment thereof binds to an epitope of *C. difficile* toxin A, wherein the epitope comprises the amino acid sequence set forth in any one of SEQ ID NO: 1067 and SEQ ID NO: 1068.

In some embodiments, the antibody or binding fragment thereof has a heavy variable region having the amino acid sequence set forth in SEQ ID NO: 972 and a light chain variable region having the amino acid sequence set forth in SEQ ID NO: 973. In some embodiments, the antibody or binding fragment thereof binds to an epitope of *C. difficile* toxoid A, wherein the epitope comprises the amino acid sequence set forth in any one of SEQ ID NO: 1069 and SEQ ID NO: 1070. In some embodiments, the antibody or binding fragment thereof binds to an epitope of *C. difficile* toxin A, wherein the epitope comprises the amino acid sequence set forth in any one of SEQ ID NO: 1069 and SEQ ID NO: 1070.

In some embodiments, the antibody or binding fragment thereof has a heavy variable region having the amino acid sequence set forth in SEQ ID NO: 974 and a light chain variable region having the amino acid sequence set forth in SEQ ID NO: 975. In some embodiments, the antibody or binding fragment thereof binds to an epitope of *C. difficile* toxoid A, wherein the epitope comprises the amino acid sequence set forth in any one of SEQ ID NO: 1071 and SEQ ID NO: 1072. In some embodiments, the antibody or binding fragment thereof binds to an epitope of *C. difficile* toxin A, wherein the epitope comprises the amino acid sequence set forth in any one of SEQ ID NO: 1071 and SEQ ID NO: 1072.

In some embodiments, the antibody or binding fragment thereof has a heavy variable region having the amino acid sequence set forth in SEQ ID NO: 976 and a light chain variable region having the amino acid sequence set forth in SEQ ID NO: 977. In some embodiments, the antibody or binding fragment thereof binds to an epitope of *C. difficile* toxoid A, wherein the epitope comprises the amino acid sequence set forth in any one of SEQ ID NO: 1071 and SEQ ID NO: 1072. In some embodiments, the antibody or binding fragment thereof binds to an epitope of *C. difficile* toxin A, wherein the epitope comprises the amino acid sequence set forth in any one of SEQ ID NO: 1071 and SEQ ID NO: 1072.

In some embodiments, the antibody or binding fragment thereof has a heavy variable region having the amino acid sequence set forth in SEQ ID NO: 978 and a light chain variable region having the amino acid sequence set forth in SEQ ID NO: 979. In some embodiments, the antibody or binding fragment thereof binds to an epitope of *C. difficile* toxoid A, wherein the epitope comprises the amino acid sequence set forth in any one of SEQ ID NO: 1073 and SEQ ID NO: 1074. In some embodiments, the antibody or binding fragment thereof binds to an epitope of *C. difficile* toxin A, wherein the epitope comprises the amino acid sequence set forth in any one of SEQ ID NO: 1073 and SEQ ID NO: 1074.

In some embodiments, the antibody or binding fragment thereof has a heavy variable region having the amino acid sequence set forth in SEQ ID NO: 980 and a light chain variable region having the amino acid sequence set forth in SEQ ID NO: 981.

In some embodiments, the antibody or binding fragment thereof has a heavy variable region having the amino acid sequence set forth in SEQ ID NO: 982 and a light chain variable region having the amino acid sequence set forth in SEQ ID NO: 983. In some embodiments, the antibody or binding fragment thereof binds to an epitope of *C. difficile* toxoid A, wherein the epitope comprises the amino acid sequence set forth in any one of SEQ ID NO: 1075 and SEQ ID NO: 1076. In some embodiments, the antibody or binding fragment thereof binds to an epitope of *C. difficile* toxin A, wherein the epitope comprises the amino acid sequence set forth in any one of SEQ ID NO: 1073 and SEQ ID NO: 1074.

In some embodiments, the antibody or binding fragment thereof has a heavy variable region having the amino acid sequence set forth in SEQ ID NO: 984 and a light chain variable region having the amino acid sequence set forth in SEQ ID NO: 985.

In some embodiments, the antibody or binding fragment thereof has a heavy variable region having the amino acid sequence set forth in SEQ ID NO: 986 and a light chain variable region having the amino acid sequence set forth in SEQ ID NO: 987. In some embodiments, the antibody or binding fragment thereof binds to an epitope of *C. difficile* toxoid A, wherein the epitope comprises the amino acid sequence set forth in any one of SEQ ID NO: 1077 and SEQ ID NO: 1078. In some embodiments, the antibody or binding fragment thereof binds to an epitope of *C. difficile* toxin A, wherein the epitope comprises the amino acid sequence set forth in any one of SEQ ID NO: 1077 and SEQ ID NO: 1078.

In some embodiments, the antibody or binding fragment thereof has a heavy variable region having the amino acid sequence set forth in SEQ ID NO: 988 and a light chain variable region having the amino acid sequence set forth in SEQ ID NO: 989.

In some embodiments, the antibody or binding fragment thereof has a heavy variable region having the amino acid sequence set forth in SEQ ID NO: 990 and a light chain variable region having the amino acid sequence set forth in SEQ ID NO: 991.

In some embodiments, the antibody or binding fragment thereof has a heavy variable region having the amino acid sequence set forth in SEQ ID NO: 992 and a light chain variable region having the amino acid sequence set forth in SEQ ID NO: 993.

In some embodiments, the antibody or binding fragment thereof has a heavy variable region having the amino acid sequence set forth in SEQ ID NO: 994 and a light chain variable region having the amino acid sequence set forth in SEQ ID NO: 995. In some embodiments, the antibody or binding fragment thereof binds to an epitope of *C. difficile* toxoid A, wherein the epitope comprises the amino acid sequence set forth in any one of SEQ ID NO: 1079 and SEQ ID NO: 1080. In some embodiments, the antibody or binding fragment thereof binds to an epitope of *C. difficile* toxin A, wherein the epitope comprises the amino acid sequence set forth in any one of SEQ ID NO: 1079 and SEQ ID NO: 1080.

In some embodiments, the antibody or binding fragment thereof has a heavy variable region having the amino acid sequence set forth in SEQ ID NO: 996 and a light chain variable region having the amino acid sequence set forth in SEQ ID NO: 997. In some embodiments, the antibody or binding fragment thereof binds to an epitope of *C. difficile* toxoid A, wherein the epitope comprises the amino acid sequence set forth in any one of SEQ ID NO: 1081-SEQ ID NO: 1083. In some embodiments, the antibody or binding fragment thereof binds to an epitope of *C. difficile* toxin A, wherein the epitope comprises the amino acid sequence set forth in any one of SEQ ID NO: 1081-SEQ ID NO: 1083.

In some embodiments, the antibody or binding fragment thereof has a heavy variable region having the amino acid sequence set forth in SEQ ID NO: 998 and a light chain variable region having the amino acid sequence set forth in SEQ ID NO: 999.

In some embodiments, the antibody or binding fragment thereof has a heavy variable region having the amino acid sequence set forth in SEQ ID NO: 1000 and a light chain variable region having the amino acid sequence set forth in SEQ ID NO: 1001. In some embodiments, the antibody or binding fragment thereof binds to an epitope of *C. difficile* toxoid A, wherein the epitope comprises the amino acid sequence set forth in SEQ ID NO: 1084. In some embodiments, the antibody or binding fragment thereof binds to an epitope of *C. difficile* toxin A, wherein the epitope comprises the amino acid sequence set forth in SEQ ID NO: 1084.

In some embodiments, the antibody or binding fragment thereof has a heavy variable region having the amino acid sequence set forth in SEQ ID NO: 1002 and a light chain variable region having the amino acid sequence set forth in SEQ ID NO: 1003. In some embodiments, the antibody or binding fragment thereof binds to an epitope of *C. difficile* toxoid A, wherein the epitope comprises the amino acid sequence set forth in any one of SEQ ID NO: 1085-SEQ ID NO: 1088. In some embodiments, the antibody or binding fragment thereof binds to an epitope of *C. difficile* toxin A, wherein the epitope comprises the amino acid sequence set forth in any one of SEQ ID NO: 1085-SEQ ID NO: 1088.

In some embodiments, the antibody or binding fragment thereof has a heavy variable region having the amino acid sequence set forth in SEQ ID NO: 1004 and a light chain variable region having the amino acid sequence set forth in SEQ ID NO: 1005. In some embodiments, the antibody or binding fragment thereof binds to an epitope of *C. difficile* toxoid A, wherein the epitope comprises the amino acid sequence set forth in any one of SEQ ID NO: 1088-SEQ ID NO: 1090. In some embodiments, the antibody or binding fragment thereof binds to an epitope of *C. difficile* toxin A, wherein the epitope comprises the amino acid sequence set forth in any one of SEQ ID NO: 1088-SEQ ID NO: 1090.

In some embodiments, the antibody or binding fragment thereof has a heavy variable region having the amino acid sequence set forth in SEQ ID NO: 1006 and a light chain variable region having the amino acid sequence set forth in SEQ ID NO: 1007.

In some embodiments, the antibody or binding fragment thereof has a heavy variable region having the amino acid sequence set forth in SEQ ID NO: 1008 and a light chain variable region having the amino acid sequence set forth in SEQ ID NO: 1009.

In some embodiments, the antibody or binding fragment thereof has a Kd for *C. difficile* toxin of 0.01 to 277.

In one aspect, the invention relates to an antibody or binding fragment thereof specific to a TcdA from any wild type *C. difficile* strain, such as those described above, e.g., to SEQ ID NO: 1. In another aspect, the invention relates to an antibody or binding fragment thereof specific to an immunogenic composition described above. For example, in one embodiment, the antibody or binding fragment thereof is specific to an immunogenic composition that includes SEQ ID NO: 4 or SEQ ID NO: 7. In another embodiment, the antibody or binding fragment thereof is specific to an immunogenic composition that includes SEQ ID NO: 4 or SEQ ID NO: 7, wherein at least one amino acid of SEQ ID NO: 4 or SEQ ID NO: 7 is crosslinked by formaldehyde, EDC, NHS, or a combination of EDC and NHS. In another embodiment, the antibody or binding fragment thereof is specific to an immunogenic composition that includes SEQ ID NO: 84 or SEQ ID NO: 83.

Antibodies or binding fragments thereof having a variable heavy chain and variable light chain regions that are at least about 90%, 91%, 92%, 93%, 94%, 95%, 96%, 97%, preferably about 98%, more preferably about 99% or most preferably about 100% identity to the variable heavy and light chain regions having any one of the amino acid sequences set forth in SEQ ID NO: 888-1015.

In one exemplary embodiment, the antibody or binding fragment thereof specific to *C. difficile* toxin A specifically binds to an epitope within the N-terminal region of TcdA e.g., an epitope between amino acids 1-1256 of a TcdA, according to the numbering of SEQ ID NO: 1.

In a preferred embodiment, the antibody or binding fragment thereof specific to *C. difficile* toxin A specifically binds to an epitope within the C-terminal region of toxin A, e.g., an epitope between amino acids 1832 to 2710 of a TcdA, according to the numbering of SEQ ID NO: 1.

In yet another embodiment, the antibody or binding fragment thereof specific to *C. difficile* toxin A specifically binds to an epitope within the "translocation" region of *C. difficile* toxin A, e.g., an epitope that preferably includes residues 956-1128 of a TcdA, according to the numbering of SEQ ID NO: 1, such as an epitope between amino acids 659-1832 of a TcdA, according to the numbering of SEQ ID NO: 1.

In another aspect, the invention relates to an antibody or binding fragment thereof specific to *C. difficile* TcdB. For example, the antibody or binding fragment thereof may be specific to a TcdB from any wild type *C. difficile* strain, such as those described above, e.g., to SEQ ID NO: 2. In another aspect, the invention relates to an antibody or binding fragment thereof specific to an immunogenic composition described above. For example, in one embodiment, the antibody or binding fragment thereof is specific to an immunogenic composition that includes SEQ ID NO: 6 or SEQ ID NO: 8.

In another embodiment, the antibody or binding fragment thereof is specific to an immunogenic composition that includes SEQ ID NO: 6 or SEQ ID NO: 8, wherein at least one amino acid of SEQ ID NO: 6 or SEQ ID NO: 8 is crosslinked by formaldehyde, EDC, NHS, or a combination of EDC and NHS. In another embodiment, the antibody or binding fragment thereof is specific to an immunogenic composition that includes SEQ ID NO: 86 or SEQ ID NO: 85.

Monoclonal antibodies that specifically bind to TcdB include antibodies produced by the B2-31; B5-40, B70-2; B6-30; B9-30; B59-3; B60-2; B56-6; and/or, preferably, B8-26 clones described herein. In some embodiments, the antibody or binding fragment thereof that specifically binds to TcdB has any one of the amino acid sequences set forth in SEQ ID NO: 1010-889.

In some embodiments, the antibody or binding fragment thereof has a heavy variable region having the amino acid sequence set forth in SEQ ID NO: 1010 and a light chain variable region having the amino acid sequence set forth in SEQ ID NO: 1011.

In some embodiments, the antibody or binding fragment thereof has a heavy variable region having the amino acid sequence set forth in SEQ ID NO: 1012 and a light chain variable region having the amino acid sequence set forth in SEQ ID NO: 1013.

In some embodiments, the antibody or binding fragment thereof has a heavy variable region having the amino acid sequence set forth in SEQ ID NO: 1014 and a light chain variable region having the amino acid sequence set forth in SEQ ID NO: 1015.

In some embodiments, the antibody or binding fragment thereof binds to an epitope of C. difficile toxin A, wherein the epitope comprises the amino acid sequence set forth in any one of SEQ ID NO: 1016-SEQ ID NO: 1090.

Antibodies or binding fragments thereof that can also bind to TcdB include those having a variable heavy chain and variable light chain regions that are at least about 90%, 91%, 92%, 93%, 94%, 95%, 96%, 97%, preferably about 98%, more preferably about 99% or most preferably about 100% identity to the variable heavy and light chain regions of B2-31; B5-40, B70-2; B6-30; B9-30; B59-3; B60-2; B56-6, preferably B8-26, B59-3, and/or B9-30. In some embodiments, the antibodies or binding fragments thereof that may bind to TcdB include those having a variable heavy chain and variable light chain regions set forth in the respective amino acid sequence of SEQ ID NO: 1016-SEQ ID NO: 1090.

In another aspect, the invention relates to an antibody or binding fragment thereof specific to an immunogenic composition described above. For example, in one embodiment, the antibody or binding fragment thereof is specific to an immunogenic composition that includes SEQ ID NO: 6 or SEQ ID NO: 8, or. In another embodiment, the antibody or binding fragment thereof is specific to an immunogenic composition that includes SEQ ID NO: 6 or SEQ ID NO: 8, wherein at least one amino acid of SEQ ID NO: 6 or SEQ ID NO: 8 is crosslinked by formaldehyde, EDC, NHS, or a combination of EDC and NHS.

In an exemplary embodiment, the antibody or binding fragment thereof specific to C. difficile toxin B specifically binds to an epitope within the C-terminal region of toxin B, e.g., an epitope between amino acids 1832 to 2710 of a TcdB, according to the numbering of SEQ ID NO: 2.

In yet another embodiment, the antibody or binding fragment thereof specific to C. difficile toxin B specifically binds to an epitope within the "translocation" region of C. difficile toxin B, e.g., an epitope that preferably includes residues 956-1128 of a TcdB, according to the numbering of SEQ ID NO: 2, such as an epitope between amino acids 659-1832 of a TcdB. Examples include B59-3; B60-2; and B56-6.

Combinations of Antibodies

The anti-toxin antibody or binding fragment thereof can be administered in combination with other anti-C. difficile toxin antibodies (e.g., other monoclonal antibodies, polyclonal gamma-globulin) or a binding fragment thereof. Combinations that can be used include an anti-toxin A antibody or binding fragment thereof and an anti-toxin B antibody or binding fragment thereof.

In another embodiment, a combination includes an anti-toxin A antibody or binding fragment thereof and another anti-toxin A antibody or binding fragment thereof. Preferably, the combination includes a neutralizing anti-toxin A monoclonal antibody or binding fragment thereof and another neutralizing anti-toxin A monoclonal antibody or binding fragment thereof.

In a further embodiment, a combination includes an anti-toxin B antibody or binding fragment thereof and another anti-toxin B antibody or binding fragment thereof. Preferably, the combination includes a neutralizing anti-toxin B monoclonal antibody or binding fragment thereof and another neutralizing anti-toxin B monoclonal antibody or binding fragment thereof.

In yet another embodiment, a combination includes an anti-toxin B antibody or binding fragment thereof and another anti-toxin B antibody or binding fragment thereof. As stated previously, the inventors discovered that a combination of at least two of the neutralizing monoclonal antibodies can exhibit an unexpectedly synergistic effect in respective neutralization of toxin A and toxin B.

In another embodiment, the agents of the invention can be formulated as a mixture, or chemically or genetically linked using art recognized techniques thereby resulting in covalently linked antibodies (or covalently linked antibody fragments), having both anti-toxin A and anti-toxin B binding properties. The combined formulation may be guided by a determination of one or more parameters such as the affinity, avidity, or biological efficacy of the agent alone or in combination with another agent.

Such combination therapies are preferably additive and/or synergistic in their therapeutic activity, e.g., in the inhibition, prevention (e.g., of relapse), and/or treatment of C. difficile—related diseases or disorders. Administering such combination therapies can decrease the dosage of the therapeutic agent (e.g., antibody or antibody fragment mixture, or cross-linked or genetically fused bispecific antibody or antibody fragment) needed to achieve the desired effect.

It is understood that any of the inventive compositions, for example, an anti-toxin A and/or anti-toxin B antibody or binding fragment thereof, can be combined in different ratios or amounts for therapeutic effect. For example, the anti-toxin A and anti-toxin B antibody or respective binding fragment thereof can be present in a composition at a ratio in the range of 0.1:10 to 10:0.1, A:B. In another embodiment, the anti-toxin A and anti-toxin B antibody or respective binding fragment thereof can be present in a composition at a ratio in the range of 0.1:10 to 10:0.1, B:A.

In another aspect, the invention relates to a method of producing a neutralizing antibody against a C. difficile TcdA. The method includes administering an immunogenic composition as described above to a mammal, and recovering the antibody from the mammal. In a preferred embodiment, the immunogenic composition includes a mutant C. difficile TcdA having SEQ ID NO: 4, wherein at least one amino acid of the mutant *C. difficile* TcdA is chemically crosslinked, preferably by formaldehyde or 1-ethyl-3-(3-dimethylamino-propyl) carbodiimide.

In yet another aspect, the invention relates to a method of producing a neutralizing antibody against a *C. difficile* TcdB. The method includes administering an immunogenic composition as described above to a mammal, and recovering the antibody from the mammal. In a preferred embodiment, the immunogenic composition includes a mutant *C. difficile* TcdB having SEQ ID NO: 6, wherein at least one amino acid of the mutant *C. difficile* TcdB is chemically crosslinked, preferably by formaldehyde or 1-ethyl-3-(3-dimethylamino-propyl) carbodiimide.

In another embodiment, a composition including an anti-toxin A antibody or binding fragment thereof may be administered to the mammal before, concurrently with, or after administration of a composition including an anti-toxin B antibody or binding fragment thereof. Conversely, a composition including an anti-toxin B antibody or binding fragment thereof may be administered to the mammal before, concurrently with, or after administration of a composition including an anti-toxin A antibody or binding fragment thereof.

Administration of an effective amount of the composition may improve at least one sign or symptom of *C. difficile* infection in the subject, such as those described below. Administration of an effective amount of the compositions described herein may, for example, decrease severity of and/or decrease occurrences of diarrhea; decrease severity of and/or decrease occurrences of abdominal pain, cramps, fever, inflammation on colonic biopsy, hypoalbuminemia, anasarca, leukocytosis, sepsis, and/or asymptomatic carriage, etc., as compared to a mammal to which the composition was not administered. Optionally, the presence of symptoms, signs, and/or risk factors of an infection is determined before beginning treatment. In a preferred embodiment, the method includes administering an effective amount of an antibody and/or binding fragment thereof described herein to the mammal suspected of, or presently suffering from, a *C. difficile* infection.

EXAMPLES

The following Examples illustrate embodiments of the invention. Unless noted otherwise herein, reference is made in the following Examples to a "vaccine candidate," "investigational *C. difficile* vaccine," or "immunogenic composition" (also referred to as "PF-06425090") that includes a mixture of genetically modified *C. difficile* toxoid A, i.e., polypeptide, (comprising SEQ ID NO: 4, wherein the initial methionine is not present) and genetically modified *C. difficile* toxoid B, i.e., polypeptide, (comprising SEQ ID NO: 6, wherein the initial methionine is not present) that were further chemically inactivated by 1-ethyl-3-(3-dimethylami-nopropyl) carbodiimide) (EDC) and N-Hydroxysuccinimide (NHS) to eliminate residual cytotoxicity but retain native antigenic structure and generate a neutralizing antibody response, as described in Example 21 of WIPO Patent Application WO/2012/143902, U.S. Pat. No. 9,187,536, and WIPO Patent Application WO/2014/060898, WIPO Patent Application WO/2012/143902, U.S. Pat. No. 9,187,536, and WIPO Patent Application WO/2014/060898, which are each incorporated by reference herein in their respective entireties. Briefly, after purification, the genetic mutant toxins (SEQ ID NO: 4 and SEQ ID NO: 6) are inactivated for 2 hours at 25° C. using 0.5 mg EDC and 0.5 mg NHS per mg of purified genetic mutant toxin A and B (approximately 2.6 mM and 4.4 mM respectively). The reaction is quenched by the addition of glycine to a final concentration of 100 mM and the reactions incubate for an additional 2 hours at 25° C. The inactivation is carried out at pH 7.0±0.5 in 10 mM phosphate, 150 mM sodium chloride buffer. The inactivation period is set to exceed three times the period needed for reduction in the $EC_{50}$ in IMR90 cells to greater than 1000 ug/mL. After 2 hours, the biological activity is reduced 7 to 8 logo relative to the native toxin. Following the 4 hour incubation, the inactivated mutant toxin is exchanged into the final drug substance buffer by diafiltration. For example, using a 100 kD regenerated cellulose acetate ultrafiltration cassette, the inactivated toxin is concentrated to 1-2 mg/mL and buffer-exchanged. More specifically, the vaccine composition includes (a) a first polypeptide, which includes the amino acid sequence set forth in SEQ ID NO: 4, wherein the methionine residue at position 1 of SEQ ID NO: 4 is not present, wherein a side chain of a lysine residue of the first polypeptide is crosslinked to a beta-alanine moiety, and wherein the first polypeptide further includes a crosslink between a side chain of an aspartic acid residue of the first polypeptide and a glycine moiety, and a crosslink between a side chain of a glutamic acid residue of the first polypeptide and a glycine moiety; and (b) a second polypeptide, which includes the amino acid sequence set forth in SEQ ID NO: 6, wherein the methionine residue at position 1 of SEQ ID NO: 6 is not present, wherein a side chain of a lysine residue of the second polypeptide is crosslinked to a beta-alanine moiety, and wherein the second polypeptide further includes a crosslink between a side chain of an aspartic acid residue of the second polypeptide and a glycine moiety, and a crosslink between a side chain of a glutamic acid residue of the second polypeptide and a glycine moiety.

The investigational *C. difficile* vaccine is composed of 2 toxoids (A and B) in equal amounts. The vaccine was provided as a sterile lyophilized powder at dosage strengths of 100 µg and 200 µg of toxoids A and B combined per dose. The vaccine was prepared for injection by resuspending the lyophilized vaccine with the aluminum hydroxide diluent immediately before use. The aluminum hydroxide diluent was supplied as a 1-mg aluminum/mL (as aluminum hydroxide) liquid suspension.

More specifically, the theoretical molecular mass of the genetically modified toxin A (SEQ ID NO: 4), prior to chemical inactivation, is 307,968 Daltons (Da). This mass assumes des-Met on the N-terminus, all Cys in the reduced form and no additional posttranslational modifications. The theoretical molecular mass of the genetically modified toxin B (SEQ ID NO: 6), prior to chemical inactivation, is 269,461 Da. This mass assumes des-Met on the N-terminus, all Cys in the reduced form and no additional posttranslational modifications. The inherent biological activity of the toxin (glucosyltransferase activity and autocatalytic protease activity) is abrogated via site-directed mutagenesis and chemical inactivation with EDC/NHS.

Lyophilized Vaccine Drug Product Formulation. The *C difficile* vaccine drug product is presented as a sterile lyophilized powder with a 1:1 ratio of TxdA DS and TxdB DS in a dosage strength of 200 µg/dose (total dose for TxdA DS and TxdB DS). For Phase 3 a dose of 200 µg is being used. The drug product is supplied in a 2 mL, 13 mm Type I glass vial with a Flurotec coated stopper and aluminum overseal. The *C difficile* vaccine drug product vials should be stored at 2-8° C. The lyophilized drug product is reconstituted with an aluminum hydroxide diluent for a 0.5 mL IM injection. The reconstituted vaccine contains 0.017% Tromethamine, 0.136% Tris-HCl, 4.5% Trehalose dehydrate, 0.01% Polysorbate 80, 0.35% sodium chloride and 0.1% Aluminum in the form of aluminum hydroxide. (See Dosage and Administration Instructions for details.) Earlier studies were conducted with a 50 and 100 µg/dose strength in addition to the 200 µg dose. In these earlier studies the drug product was reconstituted with aluminum hydroxide diluent, sodium chloride diluent or QS-21 adjuvant product.

Aluminum Hydroxide Diluent for *C difficile* Vaccine Drug Product Reconstitution. The aluminum hydroxide diluent is presented as a sterile liquid suspension in a dosage strength of 1 mg/mL Aluminum in the form of aluminum hydroxide containing 0.351% sodium chloride. The aluminum hydroxide is supplied as a 0.73 mL fill in a 1 mL Type I borosilicate glass syringe with plastic luer lok adapter, rubber stopper and synthetic isoprene bromobutyl rubber tip cap with plastic rigid cap cover. A total of 0.68 mL of the aluminum hydroxide diluent is used to reconstitute the lyophilized drug product.

The preparation involves reconstitution of *C difficile* vaccine drug product with aluminum hydroxide diluent using a vial adapter. The entire contents of reconstituted drug product are withdrawn in the syringe using the vial adapter to enable a dose of 0.5 mL for IM administration.

In preclinical experiments, the vaccine candidate was studied either alone or in combination with an adjuvant. In the hamster model, all vaccine formulations demonstrated a survival benefit, providing at least 90% protection from a lethal challenge with *C. difficile* spores in the immunized hamsters. In nonhuman primates, all of the toxoid vaccine formulations tested induced robust neutralizing anti-toxin antibody responses to both *C. difficile* toxin A and *C. difficile* toxin B.

Example 1

Mapping of the Neutralizing Monoclonal Antibody
Binding Epitopes Using Hydrogen-Deuterium
Exchange Mass Spectrometry and Cryogenic
Electron Microscopy: Implications for the
Understanding of the Protective Mechanisms
Afforded by the *C difficile* Vaccine Candidates

*Clostridium difficile* is a spore-forming, Gram-positive bacterium, that can cause infections in subjects with weakened immune system or following antibiotic treatment. These infections may lead to pseudomembranous colitis and antibiotic-associated diarrhea in humans. As such, *C difficile* is a major cause of nosocomial illness worldwide. Major virulence factors of the bacterium are large *clostridium* toxins A and B, that are high molecular mass proteins with intrinsic glucosyltransferase activity. Toxoids, the products of genetic and chemical modification to eliminate the cytotoxicity of toxins A and B while preserving critical neutralizing epitopes, represent the antigens included in an experimental vaccine being developed.

Figure 9:
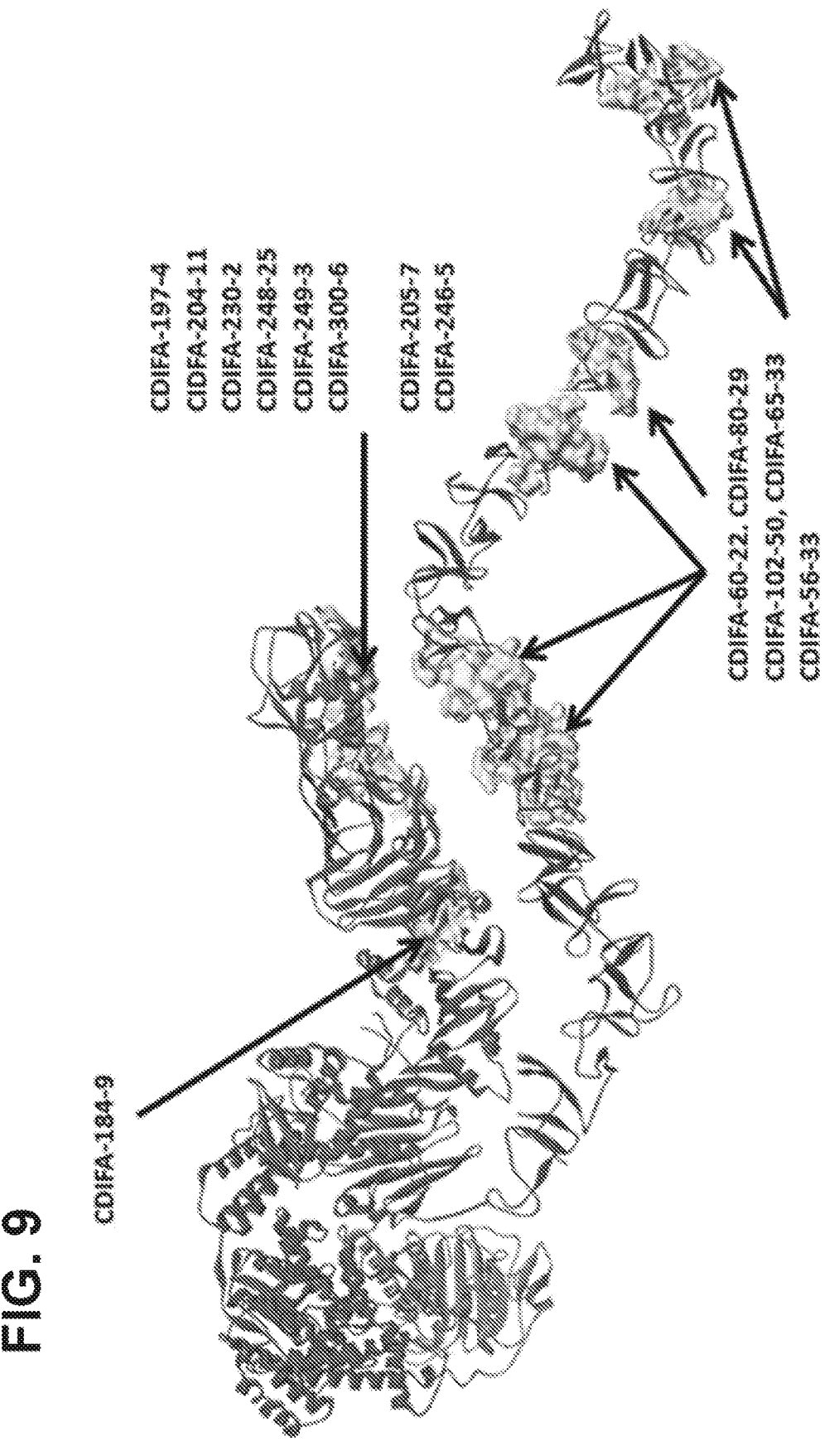
FIG. 9—binding epitopes of TxdA-specific monoclonal antibodies
Figure 10:
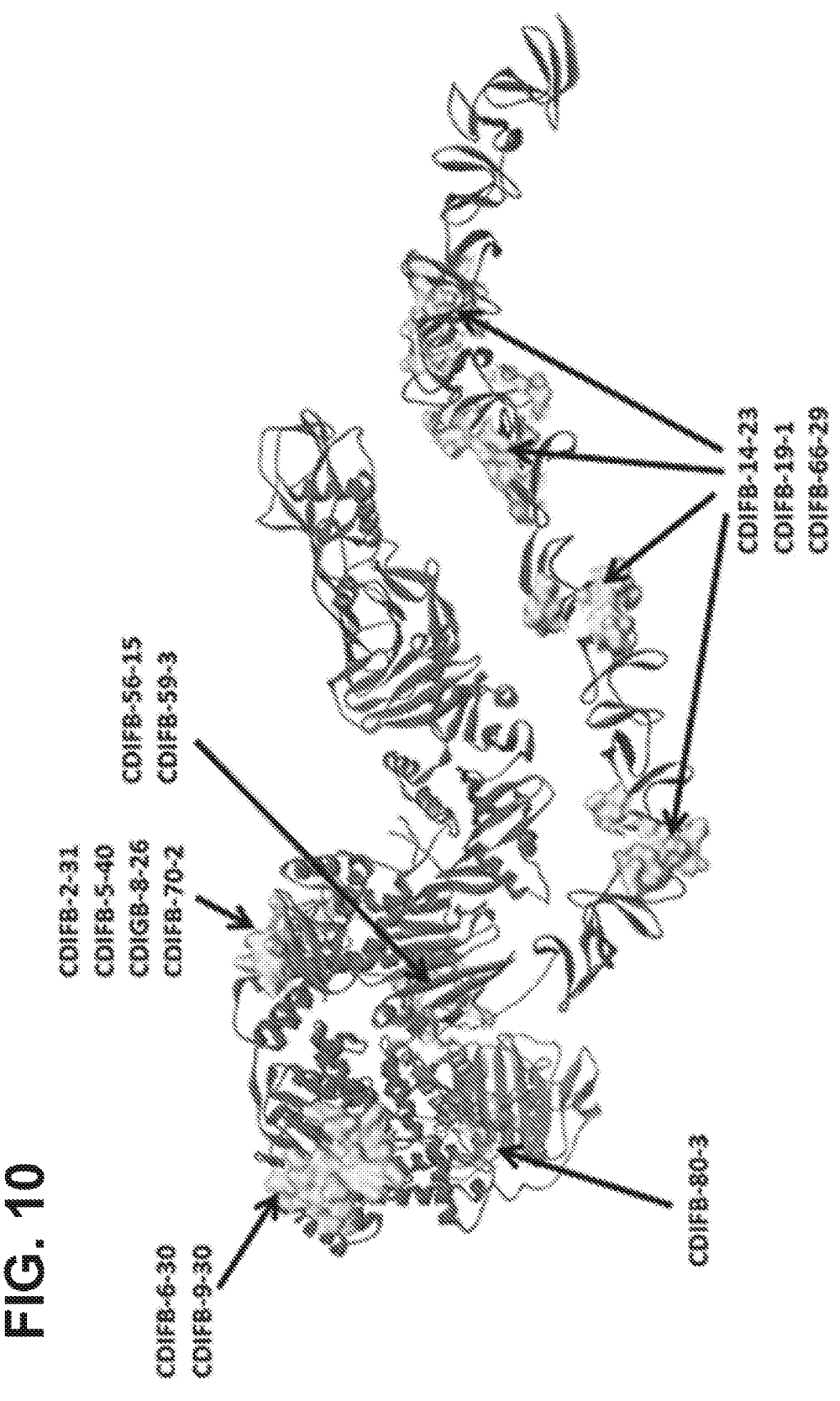
FIG. 10—binding epitopes of TxdB-specific monoclonal antibodies

Neutralizing epitopes (see FIG. 9 and FIG. 10) were identified using a combination of hydrogen-deuterium exchange mass spectrometry (HDX-MS) and cryogenic electron microscopy (cryo-EM). HDX-MS is based on differential solvent accessibility of the protein backbone with and without antibody present and provides a rapid and reliable identification of the binding epitopes, while cryo-EM is a high resolution technique that is being used to validate the HDX-MS results. Taking advantage of the high throughput afforded by HDX-MS, binding epitopes of over 30 mouse-derived monoclonal antibodies specific to the vaccine antigens were mapped. Localization of the epitopes within the functional domains of the respective antigens provides an indication as to the potential molecular mechanisms of protection afforded by antibodies induced through immunization.

Example 2

Understanding the Sequence Diversity of the
*Clostridium difficile* Virulence Factors TcdA and
TcdB: Impact on Vaccine Development

*Clostridium difficile* is the most commonly recognized cause of infectious diarrhea in healthcare settings and represents a significant unmet medical need worldwide. Currently there is no vaccine to prevent initial or recurrent *C difficile* infection (CDI). Two large clostridial glucosylating toxins, TcdA and TcdB, are the primary virulence factors for CDI. The investigational *C. difficile* vaccine, which comprises a mixture of genetically and chemically inactivated *C. difficile* toxoids A (TxdA) and B (TxdB), is currently in phase III clinical trials. An understanding of the sequence diversity of the two toxins expressed by disease causing isolates is critical for the interpretation of the immune response to the vaccine antigens. Traditional molecular typing approaches for *C. difficile* disease epidemiology studies (e.g., ribotype, MLST) do not provide insight to toxin variant diversity. The whole genome sequence (WGS) of >500 *C difficile* isolates collected from 12 countries between 2004-2018 has been determined to probe toxin variant diversity. A total of 39 unique TcdA variants (see FIG. 1) and 40 unique TcdB variants (see FIG. 2) have been identified. Each of the TcdA variants shares at least 98% amino acid sequence identity with TcdA001, the toxin variant used to develop the TxdA antigen. Sequence diversity among the TcdB variants is more substantial, ranging from 86.1% to >99% identity with TcdB001, the toxin variant used to develop the TxdB antigen.

The phylogenetic distance of the TcdA variants relative to variant TcdA001 is shown in FIG. 3. Phylogenetic distance and amino acid sequence diversity is reflected by the branch length between the respective variant types and TcdA001. Considering that toxin A is >2700 amino acids in length, differences, even at 2% of residues, correspond to >50 amino acids and these may be components of critical immune response epitopes. The greatest amino acid sequence diversity among the TcdA variants was detected within the C-terminal receptor binding domain, (e.g., among the most divergent TcdA variants, 96% sequence identity was observed over the final 500 amino acids). TcdA variant types marked by bold font in FIG. 3 correspond to toxins that have been functionally tested in neutralization assays (EXAMPLES 4, 5). Numbers in parenthesis adjacent to the TcdA variants in bold font correspond to the pairwise amino acid sequence identity with variant TcdA001.

Figure 4:
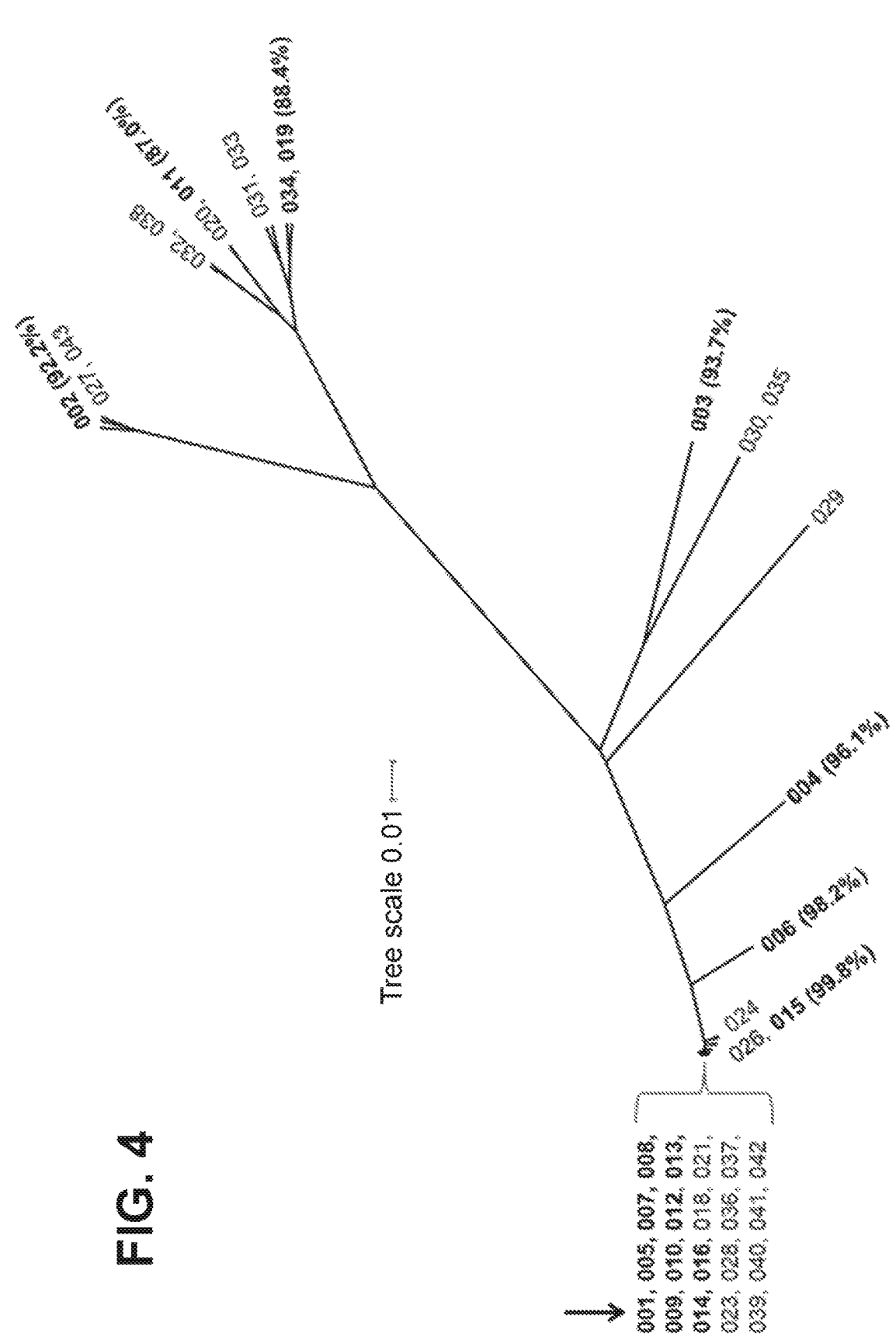
FIG. 4—Phylogenetic Diversity Among the *Clostridium difficile* Toxin B Variant Types. Phylogenetic tree illustrating the sequence similarity among the 40 TcdB protein variant types identified from WGS of strains in a *C difficile* collection. Phylogenetic distance and amino acid sequence diversity from TcdB001, whose sequence was used to make the vaccine antigen (SEQ ID NO: 6, wherein the methionine at position 1 is not present), is reflected by the branch length between the respective variant types and TcdB001. TcdB variant types in bold font correspond to the toxins that have been functionally tested in neutralization assays (see FIG. 5). Numbers in parenthesis adjacent to the TcdB variants in bold font correspond to the pairwise amino acid sequence identity with TcdB001. TcdB variants depicted in the non-bolded font have not yet been evaluated in neutralization assays.

Shown in FIG. 4, is a phylogenetic tree illustrating the sequence similarity among the 40 TcdB protein variant types identified from WGS of strains in a *C difficile* collection. Phylogenetic distance and amino acid sequence diversity from variant TcdB001 is reflected by the branch length between the respective variant types and TcdB001. While sequence diversity from TcdB001 was detected across all functional domains of the toxin B protein variants, the greatest diversity mapped to the glucosyltransferase domain of the protein. TcdB variant types in bold font correspond to the toxins that have been functionally tested in neutralization assays (EXAMPLES 4, 5). Numbers in parenthesis adjacent to the TcdB variants in bold font correspond to the pairwise amino acid sequence identity with variant TcdB001.

Example 3

Clostridium difficile Strain and Toxin Gene Diversity within a Clostridium difficile Collection As the vaccine is designed to neutralize toxins, any assessment of the breadth of the immune response needs to consider the sequence heterogeneity of the toxin proteins expressed by contemporary disease causing isolates.

Ribotyping has been the benchmark strain characterization tool used in studies from around the world. There are greater than 60 different ribotypes represented in the Pfizer C difficile strain collection. Numerous strains belonging to the hypervirulent ribotypes 027 and 078 (also referred to as BI/NAP1 and BK/NAP7, respectively) are included in the collection. Strains expressing specific toxin A and toxin B variants were not restricted to a single ribotype. For example, in the collection, the gene coding for TcdB variant 002 is detected in strains ribotyped as 003, 027, 053, 078 and 014/020 (Table 3). The inverse is also true (e.g., ribotype 003 strains code for TcdB variants 001, 002, and 010) (Table 3). These examples illustrate that PCR-ribotyping is not a strain typing tool that is predictive of the toxin variant diversity associated with C difficile disease-causing isolates.

TABLE 3

Characterization of the *Clostridium difficile* Strain Collection by Ribotype Does Not Address TcdA and TcdB Variant Diversity

| Ribotype | TcdA variants | TcdB variants |
|---|---|---|
| 027 | 002, 007, 010, 023, 048 | 002, 008, 012 |
| 001 | 010, 018 | 001, 012 |
| 078 | 007, 013 | 002, 004 |
| 002 | 010, 017 | 012, 016 |
| 003 | 018, 022 | 001, 010 |
| 013 | 010, 014, 025 | 008, 012, 021 |
| 014 | 010 | 012 |
| 053 | 001, 012, 039 | 001, 008 |
| 056 | 003, 011, 014, 042 | 012, 015, 037 |
| 070 | 015, 017 | 012, 016 |
| 106 | 002, 010, 013, 024 | 004, 009, 023, 024 |
| 126 | 013, 016, 017 | 004, 011, 016 |
| 258 | 010, 011 | 015, 026 |
| 014/020 | 003, 007, 010, 015, 043 | 001, 002, 007, 008, 012, 028, 039 |
| 018/356 | 002, 010 | 009, 012 |

Example 4

Toxin Neutralization Assay (TNA) with Immune Sera from Hamsters Immunized with Toxoid A and Toxoid B of the Investigational Vaccine Serum from hamsters immunized with Toxoids A and B (of the investigational C difficile vaccine (PF-06425090)) was used to investigate the ability to neutralize the cytotoxic activity of toxins from a representative subset of circulating C difficile isolates. The ribotype and toxin variant type of the isolates tested in toxin neutralization assay (TNA) with hamster immune sera is listed in Table 4. In this assessment, the C difficile vaccine immune serum from hamsters was able to neutralize the cytotoxic activity of each of the toxins tested.

TABLE 4

Hamster Immune Serum is Able to Neutralize the Cytotoxicity of Toxins Produced by Each of the Following *Clostridium difficile* Isolates

| C difficile Strain ID | Ribotype | TcdA | TcdB |
|---|---|---|---|
| PFECD0001 | 001 | TcdA010 | TcdB012 |
| PFECD0002 | 001 | TcdA010 | TcdB012 |
| PFECD0003 | 002 | TcdA017 | TcdB016 |
| PFECD0004 | 002 | TcdA010 | TcdB012 |
| PFECD0005 | 003 | TcdA018 | TcdB010 |
| PFECD0046 | 004 | TcdA005 | TcdB001 |
| PFECD0006 | 014 | TcdA010 | TcdB012 |
| PFECD0007 | 015 | TcdA014 | TcdB005 |
| PFECD0008 | 015 | TcdA014 | TcdB005 |
| PFECD0009 | 017 | null | TcdB003 |
| PFECD0010 | 017 | null | TcdB003 |
| PFECD0011 | 020 | TcdA003 | TcdB007 |
| PFECD0012 | 023 | TcdA019 | TcdB006 |
| PFECD0013 | 027 | TcdA010 | TcdB012 |
| PFECD0014 | 027 | TcdA007 | TcdB002 |
| PFECD0015 | 027 | TcdA007 | TcdB002 |
| PFECD0016 | 029 | TcdA019 | TcdB006 |
| PFECD0017 | 046 | TcdA004 | TcdB008 |
| PFECD0018 | 053 | TcdA012 | TcdB008 |
| PFECD0019 | 053 | TcdA012 | TcdB008 |
| PFECD0020 | 053 | TcdA012 | TcdB008 |
| PFECD0021 | 059 | TcdA011 | TcdB015 |
| PFECD0022 | 070 | TcdA017 | TcdB016 |
| PFECD0023 | 070 | TcdA015 | TcdB012 |
| PFECD0024 | 075 | TcdA010 | TcdB012 |
| PFECD0025 | 077 | TcdA010 | TcdB012 |
| PFECD0026 | 077 | TcdA010 | TcdB012 |
| PFECD0027 | 078 | TcdA013 | TcdB004 |
| PFECD0028 | 078 | TcdA013 | TcdB004 |
| PFECD0029 | 078 | TcdA013 | TcdB004 |
| PFECD0030 | 078 | TcdA013 | TcdB004 |
| PFECD0031 | 081 | TcdA009 | TcdB013 |
| PFECD0032 | 087 | TcdA009 | TcdB001 |
| PFECD0033 | 095 | TcdA010 | TcdB012 |
| PFECD0034 | 106 | TcdA013 | TcdB004 |
| PFECD0035 | 106 | TcdA002 | TcdB009 |
| PFECD0036 | 117 | TcdA005 | TcdB001 |
| PFECD0037 | 126 | TcdA017 | TcdB016 |
| PFECD0038 | 126 | TcdA013 | TcdB004 |
| PFECD0039 | 126 | TcdA016 | TcdB011 |
| PFECD0040 | 131 | TcdA017 | TcdB016 |
| PFECD0041 | 154 | TcdA010 | TcdB014 |
| PFECD0042 | tbd | TcdA007 | TcdB002 |
| PFECD0043 | tbd | TcdA008 | TcdB008 |
| PFECD0044 | tbd | TcdA012 | TcdB008 |
| PFECD0045 | tbd | TcdA016 | TcdB011 |
| PFECD0047 | tbd | TcdA005 | TcdB001 |
| PFECD0048 | tbd | TcdA007 | TcdB002 |
| PFECD0049 | tbd | TcdA010 | TcdB012 |
| C difficile Strain ID | Ribotype | TcdA | TcdB |

Toxins from culture supernatants of several C difficile isolates were evaluated in neutralization assays using sera from hamsters immunized with TxdA and TxdB. Hamster immune sera was able to neutralize the cytotoxicity of each toxin preparation. The phylogenetic distance of each of the toxin variant types from the TcdA001 and TcdB001 variants is illustrated in FIG. 3 and FIG. 4.

Example 5

Further Assessment of the Breadth of Coverage of Clostridium difficile Vaccine We sought to demonstrate that the polyclonal immune response to vaccination of human subjects is effective at neutralizing toxins that represent the diversity of C difficile strains globally. A subset of isolates with diverse toxin A and toxin B protein sequences were selected for functional analysis in neutralization assays using human serum obtained from subjects immunized with the *C difficile* vaccine. These toxin variants are illustrated with bold font in FIG. 3 and FIG. 4.

Figure 5:
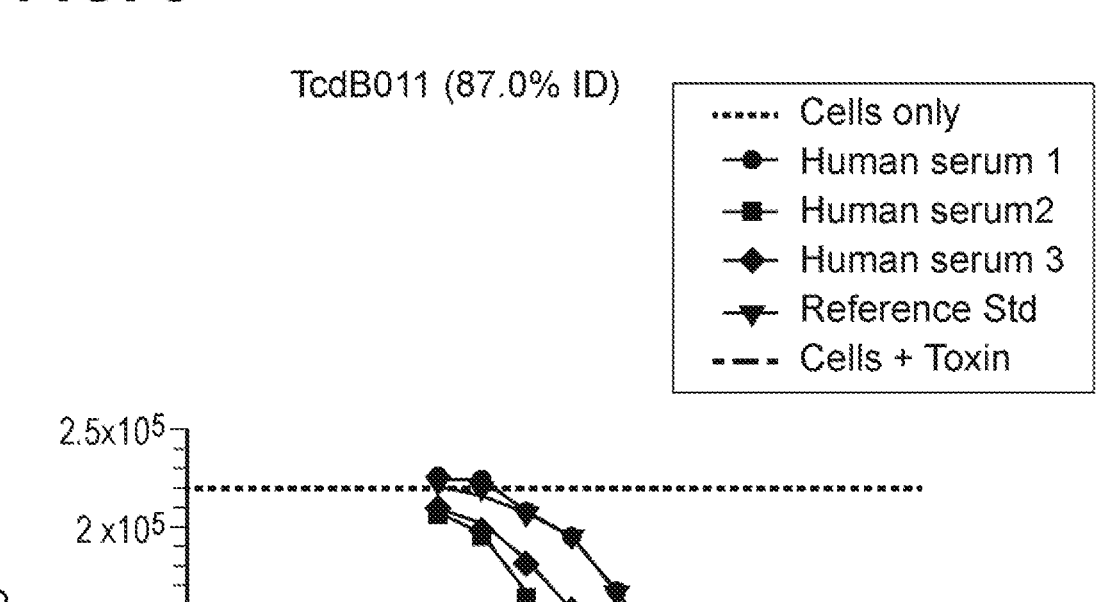
FIG. 5—Human Immune Sera is Able to Neutralize the Cytotoxicity of a TcdB Variant Heterologous to the Vaccine Antigen. Human serum from vaccinated subjects is able to neutralize the cytotoxic activity of toxin variant TcdB011 (SEQ ID NO: 811), which shares just 87% amino acid sequence identity with variant TcdB001 (FIG. 4). The level of cellular ATP, a measure of cell viability, is determined using the luminescent Cell Titer-Glo® reagent and reported as relative luminescence units (RLU). The green dashed line illustrates the luminescence output when cells are incubated in the absence of toxin, while the red dashed line provides an indication of cell viability in the presence of toxin variant TcdB011 (tested at a level of toxin equivalent to $4\times EC_{50}$ determined in a cytotoxicity assay). Sera from three vaccinated human subjects and a human reference standard are titrated from left to right and illustrate the ability of these serum samples to block or neutralize the cytotoxic effect of toxin variant TcdB011, a variant that shares just 87% amino acid sequence identity with variant TcdB001.

An example of the ability of polyclonal human immune sera to effectively neutralize the cytotoxic activity of a sequence-diverse toxin (TcdB011, 87% amino acid sequence identity with the vaccine antigen TcdB001 [FIG. 4]) is illustrated in FIG. 5. It is likely that novel toxin variants will continue to be identified as the *C difficile* strain collection grows with the addition of isolates from different geographic regions.

Human serum from vaccinated subjects is able to neutralize the cytotoxic activity of toxin variant TcdB011, which shares just 87% amino acid sequence identity with the vaccine antigen TcdB001 (FIG. 4). The level of cellular ATP, a measure of cell viability, is determined using the luminescent Cell Titer-Glo® reagent and reported as relative luminescence units (RLU). The green dashed line illustrates the I5minescence output when cells are incubated in the absence of toxin, while the red dashed line provides an indication of cell viability in the presence of toxin variant TcdB011 (tested at a level of toxin equivalent to 4× $EC_{50}$ determined in a cytotoxicity assay). Sera from three vaccinated human subjects and a human reference standard are titrated from left to right and illustrate the ability of these serum samples to block or neutralize the cytotoxic effect of toxin variant TcdB011, a variant that shares just 87% amino acid sequence identity with the vaccine antigen.

The vaccine induces polyclonal antibodies that neutralize diverse toxins and shows protection in preclinical models. See, for example, FIG. 11. The vaccine, formulated with aluminum hydroxide, has been shown to be immunogenic and well tolerated in healthy adults aged 50 to 85 years in Phase 1 and 2 clinical studies. Robust neutralizing antibodies are induced that persist over time.

Accordingly, Traditional *C. difficile* typing methods are not predictive of toxin variant diversity. *C. difficile* isolates grouped by ribotype can code for multiple and sequence diverse TcdA and TcdB variants. Diversity of TcdB variants is more substantial than TcdA variants. Antibodies induced by the investigational *C. difficile* composition (comprising a polypeptide having the amino acid sequence SEQ ID NO: 4, wherein the methionine is not present (toxoid A), and a second polypeptide having the amino acid sequence SEQ ID NO: 6, wherein the methionine is not present (toxoid B)) neutralize the cytotoxic activity of sequence diverse toxins.

Example 6

A Phase 3, Randomized, Observer-Blinded Study to Evaluate the Immunogenicity, Safety, and Tolerability of 2 Doses Compared to 3 Doses of *Clostridium Difficile* Vaccine in Adults 50 Years of Age and Older (B5091019)

Overall Design

This is a Phase 3, randomized, observer-blinded study to evaluate the immunogenicity, safety, and tolerability of a 2-dose regimen of *C difficile* vaccine compared to a 3-dose regimen of *C difficile* vaccine in adults 50 years of age and older.

Participants will be randomly assigned in parallel in a 1:1 ratio to receive *C difficile* vaccine (200 µg total toxoid) at Months 0, 1, and 6 (3-dose group) or at Months 0 and 6 (2-dose group). The participants in the 2-dose group will receive placebo (saline) at Month 1.

Investigational Products

*Clostridium difficile* Vaccine

The investigational *C difficile* vaccine is toxoid based. *C difficile* toxin A and toxin B are inactivated by a combination of genetic mutations and chemical treatments. The vaccine is provided as a sterile lyophilized powder in a dosage strength of 200 µg/dose (total for toxoids A and B). The vaccine will be reconstituted with aluminium hydroxide (AlOH) diluent immediately before use as instructed in the investigational product manual (IP manual). The AlOH diluent is supplied as a 1-mg aluminum/mL (as AlOH) liquid suspension.

Placebo (2-Dose Regimen Only)

The placebo will consist of a sterile normal saline solution for injection (0.9% sodium chloride injection, in a 0.5-mL dose) in a prefilled syringe (PFS) and will be provided by the sponsor to each study site.

Number of Participants

Approximately 500 participants will be randomized into the study, such that approximately 400 (200 per [dose] group) evaluable participants complete the study.

Statistical Methods The study sample size estimate is based on the evaluation of the primary immunogenicity objective of the study, as well as the evaluation of the secondary immunogenicity objective-to demonstrate that the immune responses induced by 2 doses of *C difficile* vaccine (administered in a 0- and 6-month regimen) are noninferior to the immune responses induced by 3 doses of *C difficile* vaccine (administered in a 0-, 1-, and 6-month regimen)—by evaluating the toxin A- and toxin B-specific neutralizing antibody in terms of GMC ratios, 1 month and 6 months after the last investigational product administration. Two hundred (200) evaluable participants per group will provide a power of 91% to meet the primary objective of noninferiority of a 2-dose to a 3-dose regimen for both toxin A and toxin B, 1 month after Dose 3; and the secondary immunogenicity objective at 6 months after Dose 3, assuming the noninferiority margin is 0.5. The primary immunogenicity objective of noninferiority of the 2-dose regimen compared with the 3-dose regimen will be achieved if the lower limit of the 2-sided 95% confidence intervals (Cis) for the GMC ratios (2-dose/3-dose regimen) is >0.5 for both toxin A and toxin B. The same criteria will be used for the secondary immunogenicity objective evaluation, which will be conducted only after the primary immunogenicity objective is met.

Assuming a maximum study nonevaluable rate of 20% and a randomization ratio of 1:1, a total of 500 participants need to be randomized in the study to meet the primary and secondary immunogenicity objectives.

The GMC ratio of the 2-dose regimen to the 3-dose regimen for *C difficile* toxin A- and toxin B-specific neutralizing antibody levels at Month 7 and Month 12 will be computed along with the 95% CIs. The GMC will be calculated as the mean of the assay results after making the logarithm transformation and then back transformation to its original scale. Two (2)-sided 95% CIs will be constructed by back transformation of the CI for the mean of the logarithmically transformed assay results computed based on the Student t distribution.

For the exploratory immunogenicity endpoints, GMCs, geometric mean fold rises (GMFRs) from baseline, and the immune response by baseline serostatus will be summarized by vaccine regimen along with the 95% CIs for both toxin A and toxin B.

All safety and reactogenicity endpoints will be summarized as proportions of participants with events by vaccine group. Additionally, exact 2-sided 95% CIs for proportions will be calculated using the Clopper-Pearson method.

Study Rationale The purpose of the study is to evaluate the immunogenicity, safety, and tolerability of a 2-dose regimen of the *C difficile* vaccine compared to a 3-dose regimen of the *C difficile* vaccine in adults 50 years of age and older. The study will recruit participants who may be at increased risk for developing CDI, and the study population, inclusion criteria, and exclusion criteria will be consistent with those of the Phase 3 B5091007 efficacy study, allowing direct immunological comparison. The *C difficile* vaccine program utilizes a 3-dose vaccine regimen at Months 0, 1, and 6 with a 200-μg dose. The 200-μg month regimen in our Phase 2 B5091009 study, our ongoing B5091007 efficacy study, and our B5091008 lot-consistency study utilize this regimen and dose.

A 2-dose vaccine regimen would presumably improve compliance. This study, therefore, will be a noninferiority study comparing a 3-dose regimen (Months 0, 1, and 6) with a 2-dose regimen (Months 0 and 6).

Mechanism of Action/Indication

The investigational *C difficile* vaccine (PF-06425090) is a prophylactic vaccine that is currently being investigated for the prevention of primary CDI in adults 50 years of age and older.

*Clostridium difficile* Vaccine Candidate

The *C difficile* vaccine candidate consists of a 1:1 mixture of *C difficile* toxoids A and B. The toxoids were derived from native toxins by genetic modification to decrease toxin activity, and chemical inactivation prior to final purification and formulation of the drug substance.

Preclinical Development

In preclinical experiments, the *C difficile* candidate vaccine was studied either alone or in combination with AlOH. Using the standard hamster *C difficile* disease model, vaccine formulations with and without AlOH demonstrated a survival benefit, providing at least 90% protection from a lethal challenge with *C difficile* spores in the immunized hamsters. In addition, pooled sera obtained from hamsters immunized with the *C difficile* vaccine formulated with AlOH neutralized secreted toxins from *C difficile* isolates representing diverse ribotypes/pulsed-field gel electrophoresis (PFGE) types, including hypervirulent strains, and covering >67% and >70% of the circulating strains in the United States and Europe, respectively. Furthermore, in nonhuman primates, the toxoid vaccine formulations with and without AlOH induced robust neutralizing antitoxin antibody responses to both TcdA and TcdB. The preclinical data generated in rhesus macaques support the use of a 3-dose regimen of the *C difficile* vaccine, with or without AlOH.

Clinical Development

The B5091001 first-in-human study was a placebo-controlled, randomized, observer-blinded Phase 1 study that evaluated the safety, tolerability, and immunogenicity of the *C difficile* vaccine. Three (3) antigen dose levels (50, 100, and 200 μg) were assessed and administered either alone or in combination with AlOH at Months 0, 1, and 6 to healthy adults 50 to 85 years of age. Overall, the *C difficile* vaccine formulations and dose levels administered were generally well tolerated. In participants who received the vaccine formulations, both the toxin A- and toxin B-specific neutralizing antibody GMCs increased substantially at 1 month after Dose 2 and after Dose 3 compared to baseline. In the 50- to 64-year age cohort, GMFRs in toxin A—specific neutralizing antibodies from baseline at Month 7 ranged from 59.19 to 149.23 in the dose groups compared to 2.47 in the control group. For toxin B-specific neutralizing antibodies, the GMFRs from baseline at Month 7 ranged from 116.67 to 2503.75 in the dose groups compared to 2.48 in the control group. In the 65- to 85-year age cohort, the GMFRs in toxin A—specific neutralizing antibodies from baseline at Month 7 ranged from 42.73 to 254.77 in the dose groups compared to 2.03 in the control group. For toxin B-specific neutralizing antibodies, the GMFRs from baseline at Month 7 ranged from 136.12 to 4922.80 in the dose groups compared to 1.58 in the control group. Potent antitoxin neutralizing responses were still evident in immunized participants in both age groups at Month 12. Although there was no clear dose-level response pattern, the data suggest that both the antitoxin A- and antitoxin B-specific neutralizing responses were trending higher in the toxoid-only groups compared to the toxoid+AlOH groups.

Furthermore, the magnitude of the immune response was similar in the 2 age cohorts.

Study B5091003, a Phase 2 study, was conducted to assess 2 antigen dose levels (100 and 200 μg) of the toxoids alone reconstituted with sodium chloride (60 mM) diluent administered as a 3-dose regimen (Days 1, 8, and 30) in healthy adults 50 to 85 years of age. Following the observed tolerability profile in Study B5091003, the decision was made to progress development of the aluminum-containing formulation into a second Phase 2 study, B5091009.

Study B5091009 (original planned stage up to 12 months after the third dose) was a Phase 2, placebo-controlled, randomized, observer-blinded study to assess the safety, tolerability, and immunogenicity of 2 antigen dose levels (100 μg and 200 μg total toxoid) of aluminum hydroxide—containing *C difficile* vaccine administered as a 3-dose regimen: either at Days 1, 8, and 30 (day regimen) or at Months 0, 1, and 6 (month regimen) in participants at US sites.

Results from the original planned stage of the study demonstrated that the 200-μg dose level was more immunogenic, as evidenced by numerically higher proportions of participants achieving antibody levels≥prespecified thresholds, GMCs, and GMFRs, than the 100-μg dose level in both dosing regimens. The month regimen resulted in numerically higher post—Dose 3 immune response for both the 100-μg and 200-μg dose levels, particularly for toxin B in participants who were seronegative at baseline. The immune responses by age group (65 to 69 years, 70 to 74 years, and 75 to 79 years) were similar to that of the combined age group (65 to 85 years) as determined by proportions of participants achieving both toxin A- and toxin B-specific neutralizing antibody levels≥specified thresholds, GMCs, and GMFRs at 1 month after Dose 3 for the month regimen and 7 days after Dose 3 for the day regimen. The number of participants 80 to 85 years of age was small and the interpretation of results for this age group should be conducted with caution. Local reactions increased after Dose 2 for both regimens, but it was to a greater extent when it was administered at Day 8 in the day regimen, particularly at the 200-μg dose level. Rates of systemic events were similar between placebo and the 2 vaccine dose levels. Overall, the AE profile observed in this study identified no untoward safety signals. Overall, the *C difficile* vaccine was highly immunogenic, was well tolerated, and exhibited an acceptable safety profile. The ongoing Phase 3 efficacy study (B5091007) is a placebo-controlled, randomized (1:1, vaccine:placebo), observer-blinded, parallel-group study in participants 50 years of age or older who have an increased risk of CDI. In the absence of an accepted immunological correlate of protection for CDI, vaccine efficacy (VE) will be determined by comparing the CDI incidence in recipients of the investigational vaccine with those receiving placebo.

The ongoing Phase 3 lot-consistency study (B5091008) is a placebo-controlled, randomized 1:1:1:1 (Lot 1:Lot 2:Lot 3:placebo), observer-blinded study to evaluate the lot consistency, safety, tolerability, and immunogenicity of the C difficile vaccine 200-µg dose level administered at Months 0, 1, and 6 in healthy adults 65 to 85 years of age. The present study (B5091019) is a Phase 3, randomized, observer-blinded study to evaluate the immunogenicity, safety, and tolerability of a 3-dose C difficile vaccine regimen compared to a 2-dose C difficile vaccine regimen in adults 50 years of age and older. The B5091001 first-in-human study, which assessed 3 antigen dose levels (50, 100, and 200 µg) administered either alone or in combination with AlOH at Months 0, 1, and 6 to healthy adults 50 to 85 years of age, demonstrated that the C difficile vaccine formulations and dose levels administered were generally well tolerated.

The B5091009 Phase 2 study, which assessed 2 antigen dose levels (100 and 200 µg) administered in combination with AlOH at Months 0, 1, and 6 or Days 1, 8, and 30 to healthy adults 65 to 85 years of age, demonstrated that both regimens and both dose levels administered were generally well tolerated. After Dose 2, local reactogenicity was greater when the vaccine was administered at Day 8 compared to Month 1, particularly for the 200-µg dose level. Systemic events were also predominantly mild to moderate and the incidences of individual events were similar between the placebo group, the 100-µg dose group, and the 200-µg dose group. Within each regimen, the overall AE incidence rates were also similar between the placebo, 100-µg, and 200-µg dose groups.

Both studied dose levels resulted in substantial neutralizing antitoxin A and B titers, with the immunogenicity profile following 3 doses administered at Months 0, 1, and 6 being preferred. In addition, the 200-µg dose level was more immunogenic than the 100-µg dose level. Study B5091010, a first-in-Japanese participants study, was a Phase 1, placebo-controlled, randomized, observer-blinded study to assess the safety, tolerability (primary objectives), and immunogenicity (secondary objectives) of 2 antigen dose levels of the AlOH-containing vaccine (ie, 100 µg and 200 µg) in 2 different dosing regimens (Months 0, 1, and 6 [month regimen] or Days 1, 8, and 30 [day regimen]) in healthy Japanese adults, 65 to 85 years of age. The C difficile vaccine was well tolerated when administered in the 0-, 1-, and 6-month regimen with no unexpected AEs observed in this regimen, indicating a favorable safety profile in this elderly population of healthy Japanese adults 65 to 85 years of age when administered in the month regimen. There were no notable differences between the 100- or 200-µg dose groups observed within each regimen based on an evaluation of the proportion of participants reporting AEs, SAEs, or newly diagnosed chronic medical conditions (NDCMCs).

Thus, C difficile vaccinations at a dose of 100 or 200 µg were generally well tolerated when given according to a Month 0, 1, and 6 regimen.

The available information from Studies 85091001, 85091009, and 85091010 with PF-06425090 supports a favorable benefit-risk profile for studies administrating 3 doses of the C difficile vaccine at dose levels up to 200 µg formulated with AlOH, as a potential prevention against CDI. It is expected that this would also apply to a 2-dose regimen of the vaccine given 6 months apart, and especially so since the reactogenicity after Dose 2 (at Month 1 seen in all 3 studies, 85091001, 85091009, and 85091010) was the most pronounced.

Overall Design

This is a Phase 3, randomized, observer-blinded study to evaluate the immunogenicity, safety, and tolerability of a 2-dose C difficile vaccine regimen compared to a 3-dose C difficile vaccine regimen in adults 50 years of age and older.

Participants will be randomly assigned in parallel in a 1:1 ratio to receive one of the following dosing regimens according to the visit schedule:
  2-Dose: Participants will receive 1 dose of C difficile vaccine (200 µg total toxoid per dose) at Visit 1 (Month 0) and Visit 4 (Month 6) and 1 dose of placebo (0.9% sodium chloride or normal saline) at Visit 2 (Month 1).
  3-Dose: Participants will receive 1 dose of C difficile vaccine (200 µg total toxoid per dose) at Visit 1 (Month 0), Visit 2 (Month 1), and Visit 4 (Month 6).

Approximate Number of Participants

Approximately 500 participants will be randomized into the study, with a randomization ratio of 1:1 (2-dose C difficile vaccine:3-dose C difficile vaccine).

To achieve a broad representation of age groups among those 50 years of age and older, randomization into an age cohort will be managed by the central randomization process. The targeted number of participants and age cohorts intended to be randomized is shown in Table 5.

TABLE 5

Intended Numbers of Participants Included in the Study, by Age

| Age Category | Minimum Number for Inclusion | Maximum Number for Inclusion |
|---|---|---|
| 50-59 years | Not limited | 50 participants |
| 60-69 years | 75 | Not limited |
| ≥70 years | 75 | Not limited |

Scientific Rationale for Study Design

Demonstrating that the 2-dose vaccine regimen can generate comparable noninferior antibody responses compared with the 3-dose vaccine regimen provides the clinical rationale for a 2-dose vaccine regimen. This argument may be informed by the successful efficacy anticipated to be demonstrated in the pivotal B5091007 clinical endpoint efficacy study. Efficacy in Study B5091007 may be associated with an immunological profile after the third dose at 6 months in participants who received a 3-dose regimen at Months 0, 1, and 6. Therefore, if participants who received a 2-dose regimen at Months 0 and 6 achieve a noninferior comparable immunological response 1 month after their Month 6 dose compared with the response achieved by the participants who received a 3-dose regimen 1 month after their third dose at Month 6, where efficacy against a clinical endpoint is established, one can infer that similar VEs would be seen with the 2-dose vaccine regimen and the 3-dose vaccine regimen.

Justification for Dose

Dose selection was derived from Study B5091009 where 2 doses (100 µg and 200 µg) and 2 dosing regimens (Months 0, 1, and 6; and Days 1, 8, and 30) were compared against placebo.

The study demonstrated that the 200-µg dose level was more immunogenic as evidenced by numerically higher proportions of participants achieving antibody levels threshold, GMCs, and GMFRs than those for the 100-µg dose level in both dosing regimens; and that the month regimen resulted in a higher post—Dose 3 immune response for both the 100-µg and 200-µg dose levels.

Based on these results from Study B5091009, the dosing level to be used in Phase 3 studies is 200 µg, and the regimen to be used is 3 doses administered by intramuscular (IM) injection at Months 0, 1, and 6.

Hence, 200 µg will be used for both the 2-dose regimen (at Months 0 and 6) and the 3-dose regimen (at Months 0, 1, and 6).

Study Population

Inclusion Criteria

Participants were eligible to be included in the study only if all of the following criteria apply:

Age and Sex:

1. Male or female participants 50 years of age or older at enrollment.
2. Willing and able to comply with scheduled visits, vaccination plan, and other study procedures.
3. Participants with an increased risk of future contact with healthcare systems by virtue of:

Study Intervention(s) Administered

The investigational *C difficile* vaccine (PF-06425090) is toxoid based. *C difficile* toxin A and toxin B are inactivated by a combination of genetic mutations and chemical treatments. The vaccine is provided as a sterile lyophilized powder containing a total toxoid dose of 200 µg (100 µg each of toxoids A and B). The vaccine will be reconstituted with AlOH 1-mg/mL liquid suspension for injection (diluent) immediately before use.

Participants randomized to the 2-dose regimen will receive 2 doses of *C difficile* vaccine (200 µg total toxoid per dose) and 1 dose of placebo (sterile normal saline solution, 0.9% sodium chloride).

Participants randomized to the 3-dose regimen will receive 3 doses of *C difficile* vaccine (200 µg total toxoid per dose).

Table 6 describes the study intervention(s)s that will be administered.

TABLE 6

| | Description of Study Intervention(s) | |
|---|---|---|
| Intervention Name | PF-06425090 | Placebo for PF-06425090 |
| Regimen | *C difficile* vaccine (200 µg) 3-dose regimen and *C difficile* vaccine (200 µg) 2-dose regimen | *C difficile* vaccine (200 µg) 2-dose regimen |
| Type | Vaccine | Placebo |
| Dose Formulation | Lyophilized powder for reconstitution for injection with AlOH 1-mg/mL suspension for injection | Prefilled syringe |
| Unit Dose Strength(s) | 200 µg/dose (0.5 mL) | 0.9% sodium chloride (0.5 mL) |
| Dosage Level(s) | 0.5-mL dose at Visits 1, 2, and 4 (Months 0, 1, and 6) for 3-dose regimen 0.5-mL dose at Visits 1 and 4 (Months 0 and 6) for 2-dose regimen | 0.5-mL dose at Visit 2 (Month 1) for 2-dose regimen only |
| Route of Administration | Intramuscular | Intramuscular |
| Packaging and Labeling | Study intervention will be provided in a single-use vial. Each vial will be packaged in a carton with 1 single-dose prefilled syringe of AlOH 1-mg/mL suspension for injection (diluent) and a vial adapter. The carton will have a blinded label and a tamper-evident seal. | Study intervention will be provided in a single-dose prefilled syringe. Each syringe will be packaged in a carton with a blinded label and a tamper-evident seal. |

Abbreviations: AlOH = aluminum hydroxide; IMP = investigational medicinal product; IP manual = investigational product manual.

At least 1 inpatient hospitalization of nights' duration in the previous 12 months; or At least 2 emergency room visits in the previous 12 months; or At least 10 outpatient visits (primary and/or secondary care visits but excluding pharmacy and mental health visits) in the previous 12 months; or Residence in a skilled nursing facility (a residential institution that provides professional nursing care and rehabilitation services, usually following discharge from the hospital); or Residence in a nursing home (a residential institution that provides assistance with activities of daily living); or Inpatient hospitalization of nights' duration scheduled 37 days after randomization.

Or participants who have received systemic (ie, oral or injected) antibiotics at any time in the previous 12 weeks.

4. Ability to be contacted by telephone during study participation.

Administration

All injections will be administered in the upper deltoid muscle, preferably of the nondominant arm, by the unblinded administrator.

Participants will be administered the following injections according to the dosing regimen to which the participant is randomized:

2-Dose: Participants will receive 1 dose of *C difficile* vaccine (200 µg total toxoid per dose) at Visit 1 (Month 0) and Visit 4 (Month 6) as well as 1 dose of placebo (0.9% sodium chloride or normal saline) at Visit 2 (Month 1).

3-Dose: Participants will receive 1 dose of *C difficile* vaccine (200 µg total toxoid per dose) at Visit 1 (Month 0), Visit 2 (Month 1), and Visit 4 (Month 6).

Immunogencity Assessments

Both toxin A- and toxin B-specific neutralizing antibody levels will be measured. Approximately 20 mL (minimum of 10 mL and up to 20 mL) of blood will be collected (at Visit 1, Visit 4 [these must be prior to vaccination] Visit 5, and Visit 6) for each measurement to allow for adequate volume required for repeat testing or additional antigen-specific immunogenicity testing to be performed.

Estimands and Statistical Hypotheses

The primary objective of assessing noninferiority of the 2-dose regimen to the 3-dose regimen will be evaluated at 1 month after the last dose for each *C difficile* toxin A- or toxin B-specific neutralizing antibody. The evaluable immunogenicity population will be used for the hypothesis testing to assess the primary immunogenicity objective.

The null hypothesis (H₀) for noninferiority is:

$$H_0: \ln(\mu_2) - \ln(\mu_3) \leq -\ln(2)$$

Where $\ln(\mu_2)$ and $\ln(\mu_3)$ are the means of the natural logarithm-transformed data of the *C difficile* toxin A- or toxin B-specific neutralizing antibody concentration from participants receiving the 2-dose regimen and the 3-dose regimen, respectively, measured 1 month (primary immunogenicity endpoint) after the third vaccination (Month 7) with *C difficile* vaccine. The neutralizing antibody concentration data will be logarithmically transformed for analysis of GMC ratios, along with 95% CIs.

If the lower limit of 2-sided 95% CI for the GMC ratio (2-dose/3-dose) is >0.5 for both toxin A- and toxin B-specific neutralizing antibodies, 1 month after the third vaccination, the primary objective of establishing noninferiority of the 2-dose regimen to the 3-dose regimen is met. The same null hypothesis for the secondary immunogenicity objective will be evaluated 6 months after the third vaccination following the success of the primary objective.

Immunogenicity:

GMC ratio, estimated by the ratio of the observed GMC of toxin A- and toxin B-specific neutralizing antibody from the 2-dose regimen group to the 3-dose regimen group in participants receiving *C difficile* vaccine and in compliance with the key protocol criteria (evaluable participants).

This estimand estimates the regimen effect in the hypothetical setting where participants follow the study schedules and protocol requirements as directed. It addresses the primary objective of estimating the maximum potential difference between the 2- and 3-dose regimens, since the impact of noncompliance is likely to diminish the observed difference between the 2 regimens (e.g., when participants randomized to the 3-dose regimen receive only 2 doses).

GMC ratio, estimated by the ratio of the observed GMC of toxin A- and toxin B-specific neutralizing antibody from the 2-dose regimen group to the 3-dose regimen group in participants receiving *C difficile* vaccine and in compliance with the key protocol criteria (evaluable participants).

This estimand estimates the regimen effect in the hypothetical setting where participants follow the study schedules and protocol requirements as directed. It addresses the primary objective of estimating the maximum potential difference between the 2- and 3-dose regimens, since the impact of noncompliance is likely to diminish the observed difference between the 2 regimens (e.g., when participants randomized to the 3-dose regimen receive only 2 doses).

Example 7

Design and Conduct of a Large Phase 3 Efficacy Study of an Investigational *Clostridium difficile* Vaccine (Clover)

Background: *Clostridium* (*Clostridioides*) *difficile* infection (CDI) causes diarrhea and colitis, which can be life-threatening, mostly in patients who have had recent healthcare contact and/or received antibiotics. CDI has been recognized by the Centers for Disease Control and Prevention as an urgent public health threat. Clover (B5091007, NCT03090191) is a multinational Phase 3 study evaluating the efficacy, safety and tolerability of an investigational toxoid-based *C. difficile* vaccine. Since no immunological correlate of protection for CDI exists, evaluation of vaccine efficacy requires collection and microbiological testing of diarrheal specimens.

Methods: The study population and sample size were determined based upon the anticipated number of confirmed cases of CDI and were informed by epidemiological studies and literature review. Sophisticated stool collection, transport and testing methodologies were developed to assess all episodes when a subject experiences unformed stools (Bristol stool chart types 5-7) in a 24 hour period. An electronic method to maintain contact with subjects and facilitate recording of diarrheal episodes was developed.

Results: Eligibility for inclusion was based on healthcare contact in the previous 12 months, planned hospitalization or receipt of systemic antibiotics in the previous 12 weeks. The target enrolment of 17,476 subjects 50 years of age was achieved in 24 months. A stool collection kit was developed and refined after field testing. Since *C. difficile* toxins are heat labile, a simple-to-use self-cooling shipping unit that activates upon pressing a button was developed and validated. A two-step diagnostic stool testing algorithm was developed and validated: the first detects toxigenic *C. difficile* by polymerase chain reaction and the second measures the presence of toxin A and/or B by cell cytotoxicity neutralization assay using a proprietary assay. An app, used on a subject's own smartphone or a provided device, was developed to allow recording episodes of diarrhea, triggering reminders to collect stool samples and pick up, and to remind subjects periodically to demonstrate their continued participation in the study.

Example 8

Ribotype Classification of *Clostridioides difficile* Isolates is not Predictive of the Amino Acid Sequence Diversity of the Toxin Virulence Factors TcdA and TcdB

*Clostridioides* (*Clostridium*) *difficile* is the most commonly recognized cause of infectious diarrhea in healthcare settings. Currently there is no vaccine to prevent initial or recurrent *C. difficile* infection (CDI). Two large clostridial toxins, TcdA and TcdB, are the primary virulence factors for CDI. Immunological approaches to prevent CDI include antibody-mediated neutralization of the cytotoxicity of these toxins. An understanding of the sequence diversity of the two toxins expressed by disease causing isolates is critical for the interpretation of the immune response to the toxins. In this study, we determined the whole genome sequence (WGS) of 478 *C. difficile* isolates collected in 12 countries between 2004-2018 to probe toxin variant diversity. A total of 44 unique TcdA variants and 37 unique TcdB variants were identified. The amino acid sequence conservation among the TcdA variants (>98%) is considerably greater than among the TcdB variants (as low as 86.1%), suggesting that different selection pressures may have contributed to the evolution of the two toxins. Phylogenomic analysis of the WGS data demonstrate that isolates grouped together based on ribotype or MLST code for multiple different toxin variants. These findings illustrate the importance of determining not only the ribotype but also the toxin sequence when evaluating strain coverage using vaccine strategies that target these virulence factors. We recommend that toxin variant type and sequence type (ST), be used together with ribotype data to provide a more comprehensive strain classification scheme for *C. difficile* surveillance during vaccine development objectives.

Introduction

Clostridioides (*Clostridium*) *difficile*, a Gram-positive, spore-forming, obligate anaerobe, is the main cause of nosocomial infectious diarrhea in industrialized countries. The bacterium accounts for 20% to 30% of cases of antibiotic-associated diarrhea and is the most commonly recognized cause of infectious diarrhea in healthcare settings. The main risk factors for an initial episode of *C. difficile* infection (CDI) are antibiotic therapy, hospitalization, and underlying comorbidities. Older adults (≥65 years of age) are at increased risk for CDI, particularly when exposed to health care settings.

C. *difficile* can produce 3 toxins, toxin A (TcdA), toxin B (TcdB) and binary toxin (CDT). TcdA and TcdB are large single subunit proteins (approximately 308 and 270 kDa, respectively) and are considered the principal virulence factors contributing to CDI. These two toxins have similar structural features delineated by four functional domains but share just 50% overall amino acid sequence identity. The C-terminal domain of the toxin proteins, known as the combined repetitive oligopeptide (CROP) domain, facilitates toxin binding to the surface of intestinal epithelial cells. The toxins enter the cell by endocytosis where the reduced pH of endocytic vesicles triggers a conformational change in the cell entry domain of the toxin, resulting in pore formation and translocation of the glucosyltransferase domain (GTD) and autoprocessing domain (APD) to the cytosolic face of the membrane. Binding of the cytosolic cofactor InsP6 activates the APD, resulting in cleavage and release of the GTD. GTD-catalyzed transfer of glucose inactivates small cytoplasmic GTPases of the Rho family of proteins, leading to the disruption of the cytoskeleton. This manifests as a cytopathic rounding effect and cell death in the epithelium which results in diarrhea. CDT belongs to the family of binary ADP-ribosylating toxins consisting of two components: CDTa (ADP-ribosyltransferase) and CDTb (responsible for host cell binding and translocation of CDTa to the cytosol). As cdtA and cdtB are not detected in all toxigenic isolates, the significance of CDT as a virulence factor contributing to CDI remains in question.

CDI often occurs when the integrity of the normal intestinal microbiota is disturbed. The spectrum of CDI presentation includes mild self-limiting to severe diarrhea which may progress to pseudomembranous colitis, toxic megacolon, intestinal perforation, and death. Although most patients experiencing a first episode of CDI respond well to standard antibiotic treatment (which can include metronidazole, vancomycin or fidaxomicin), approximately 15% to 35% of patients suffer from at least one recurrence. Immunoprophylactic approaches that target *C. difficile* toxins have been developed for the prevention of recurrent CDI. Vaccines have been successfully developed to prevent other toxin mediated diseases, such as tetanus and diphtheria, by inducing antibodies that neutralize the cytopathic effect of the toxin. The proposed mechanism of action of these approaches is through antibody mediated (both monoclonal antibody as well as vaccine-elicited polyclonal responses) neutralization of the cytotoxic activity of toxins produced by disease-causing *C. difficile* isolates.

Several molecular methods have been used to type *C. difficile* isolates for epidemiological studies. These include restriction endonuclease analysis (REA), pulse field gel electrophoresis (PFGE), and ribotyping, a PCR-based method that takes advantage of the size heterogeneity of the intergenic spacer region (ISR) between 16S and 23S rRNA genes. Isolates can also be classified by toxinotype, a restriction fragment length polymorphism (RFLP) method that is based on changes in the *C. difficile* pathogenicity locus (PaLoc). *C. difficile* may also be grouped into five main clades and at least three additional cryptic clades based on the clustering of the concatenate multiple locus sequence typing (MLST) alleles. While each of these methods provides value for isolate characterization in epidemiological studies, none provides detailed insight to the diversity of full length TcdA and TcdB proteins. Reports on sequence-based variability within TcdA and TcdB toxins in large strain collections are uncommon. Sequence diversity within a 199 amino acid fragment of the CROP domain of TcdB (corresponding to the receptor binding domain of the toxin), has been used to differentiate toxin variant types. An understanding of toxin diversity among contemporary disease-causing isolates is essential for assessment of the immune response to the toxins. In this manuscript we report on the deduced amino acid sequence of TcdA and TcdB toxin proteins determined from whole genome nucleotide sequence data of 478 *C difficile* isolates. A total of 44 TcdA and 37 TcdB protein variants have been identified among these isolates and are presented together with detailed molecular analyses.

Methods

Strain Collection, Isolate Selection, Microbiology and DNA Isolation

Initially, a total of 504 *C. difficile* isolates, collected from multiple sources across several geographic regions between the years 2004 to 2018 were included in this study (Table 7). The isolates do not represent a prevalence-based collection. Whole genome sequence (WGS) data was collected for all isolates and the PCR ribotype was determined for each of the isolates. Toxinotype assignments were available for a subset of the isolates.

C. *difficile* isolates were either provided as glycerol stocks or were purified from stool specimens. All microbiology was conducted under anaerobic conditions. Glycerol stocks were plated onto Tryptone Soya Agar (TSA) +5% sheep blood agar plated and incubated overnight at 37° C. On day 2, a single colony was selected and re-streaked onto a new TSA +5% sheep blood agar plate and again incubated overnight at 37° C. On day 3, colonies were transferred to a 96-well plate for lysis and genomic DNA was extracted using Beckman Coulter GenFind V2 kit (Indianapolis, IN, USA). For stool specimens, a 10µl loop was used to transfer stool to 700µl 95% ethanol; 20µl of this suspension was then used to inoculate a cycloserine cefoxitin fructose agar plate, supplemented with horse blood and taurocholate (CCFA-HT) and incubated for two days at 37° C. On day 3, a single colony was picked from CCFA-HT plate and streaked onto a TSA blood agar plate followed by overnight incubation at 37° C. On day 4, the colonies were transferred to a 96-well plate for lysis and genomic DNA was extracted using the Beckman Coulter GenFind V2 kit.

Molecular Characterization of the Study Isolates

For the majority of strains, PCR-ribotyping was performed using the protocol described in Svenungsson et al. For added discrimination, PCR products are analyzed using an Agilent 2100 Bioanalyzer. Ribotype and toxinotype assignments for the toxiontype diversity subset of strains were determined as described in Bidet et al. and Rupnik et al., respectively. The nucleotide sequence of adk, atpA, dxr, glyA, recA, sodA and tpi genes was extracted from the whole genome sequence of each strain and used to assign a sequence type (ST) and Glade at PubMLST (http://pubmlst.org/cdifficile/).

Preparation of the Illumina Sequencing Library

*C. difficile* sequencing libraries were prepared by using either the TruSeq DNA Sample Prep Kits ("TruSeq") or the Nextera DNA Flex Library Prep Kit ("Flex"), both from Illumina (San Diego, CA, USA). When using the TruSeq kit, genomic DNAs are first mechanically sheared by a Covaris ME220 (Woburn, MA, USA) sonication instrument using the settings recommended by the manufacturer. After sonication, the TruSeq universal adapters are added to the ends of the genomic DNA fragments by ligation, followed by bead cleanup, size selection and quantification according to the manufacturer's protocol. When using the Flex kit, genomic DNAs are first tagmented (transposon-mediated fragmentation) and universal adapters are added to the ends of the DNA fragments by PCR, according to the manufacturer's protocol. DNA libraries (paired end, 2×300) were loaded on the Illumina Miseq for whole genome sequencing of the respective *C. difficile* genomes.

Analysis of the WGS data

Primary *C. difficile* DNA sequence reads were run through the "Merge Overlapping Pairs" program followed by assembly into contigs using the "De Novo Assembly" program in the Qiagen CLC Genomics Workbench (Redwood City, CA, USA) using default parameters. The tcdA and tcdB allele sequences were inferred by aligning the assembled contigs to the tcdA and tcdB sequences of the CD630 isolate (Genbank accession AM180355). The deduced amino acid sequences of the genes coding for TcdA and TcdB in CD630 are labeled as TcdA001 and TcdB001, respectively.

A unique toxin variant is defined as a TcdA or TcdB open reading frame (ORF) that includes all four of the functional domains and whose amino acid sequence differs by at least one amino acid from any other entry. The most challenging region for collection of high-quality DNA sequence was in the C-terminal CROP domain, particularly in the TcdA open reading frame. In some instances, these challenges were addressed by repeat sequencing with fewer input strains to achieve greater depth and/or by performing the de novo assembly program a second time without merging overlapping pairs. If the toxin variant could not be determined by the de novo assembly program, primary sequence data was aligned to the CD630 reference genome to confirm the presence of the gene.

The nomenclature developed by den Dunnen et al. has been used to describe a series of truncations and in-frame deletions predicted from the tcdA nucleotide sequence of some isolates. In these instances, the TcdA001 sequence is used as the reference when describing position in the ORF. A unique TcdA variant number has been assigned if sequence corresponding to the CROP domain is included in the truncated ORF. However, if the deduced amino acid sequence is truncated prior to the CROP domain, a TcdA variant was not assigned and the isolate has been labeled as 'truncated at TcdA'. In those isolates where the entire tcdA sequence is missing, the strain has been classified as TcdA deletion'. Acceptance criteria for each novel TcdA or TcdB variant identified required a minimum 35× nucleotide sequence coverage across the respective ORFs with less than 10% sequence heterogeneity. If these acceptance criteria were not met, the isolate was not included in the phylogenomic analysis (this included 26 of the 504 isolates in the collection). TcdA and TcdB amino acid sequences were aligned using CLC Genomics Workbench and aligned sequences were used to construct the phylogenetic tree using the unweighted pair group method with arithmetic mean (UPGMA) with bootstrapping. The phylogenomic figure was created by aligning assembled *C. difficile* genomes using Parsnp with recombination filtration option enabled. The metadata (Glade, ST, ribotype, TcdA variant type and TcdB variant type) was plotted as concentric rings using a custom-built R program.

Measurement of Toxin Variant Diversity and Distribution within Phylogenetic Clades The Simpson's Diversity Index (SDI) was used to quantitatively measure the diversity and distribution of toxin variants within phylogenetic clades of *C. difficile*. The higher the index obtained, the greater the number and distribution of the toxin variants observed within a Glade. Likewise, the lower the index, the fewer number of variants and/or a more restricted distribution of the toxin variants within a Glade.

Results

Phylogenetic Analysis of TcdA and TcdB Variants

Figure 12A:
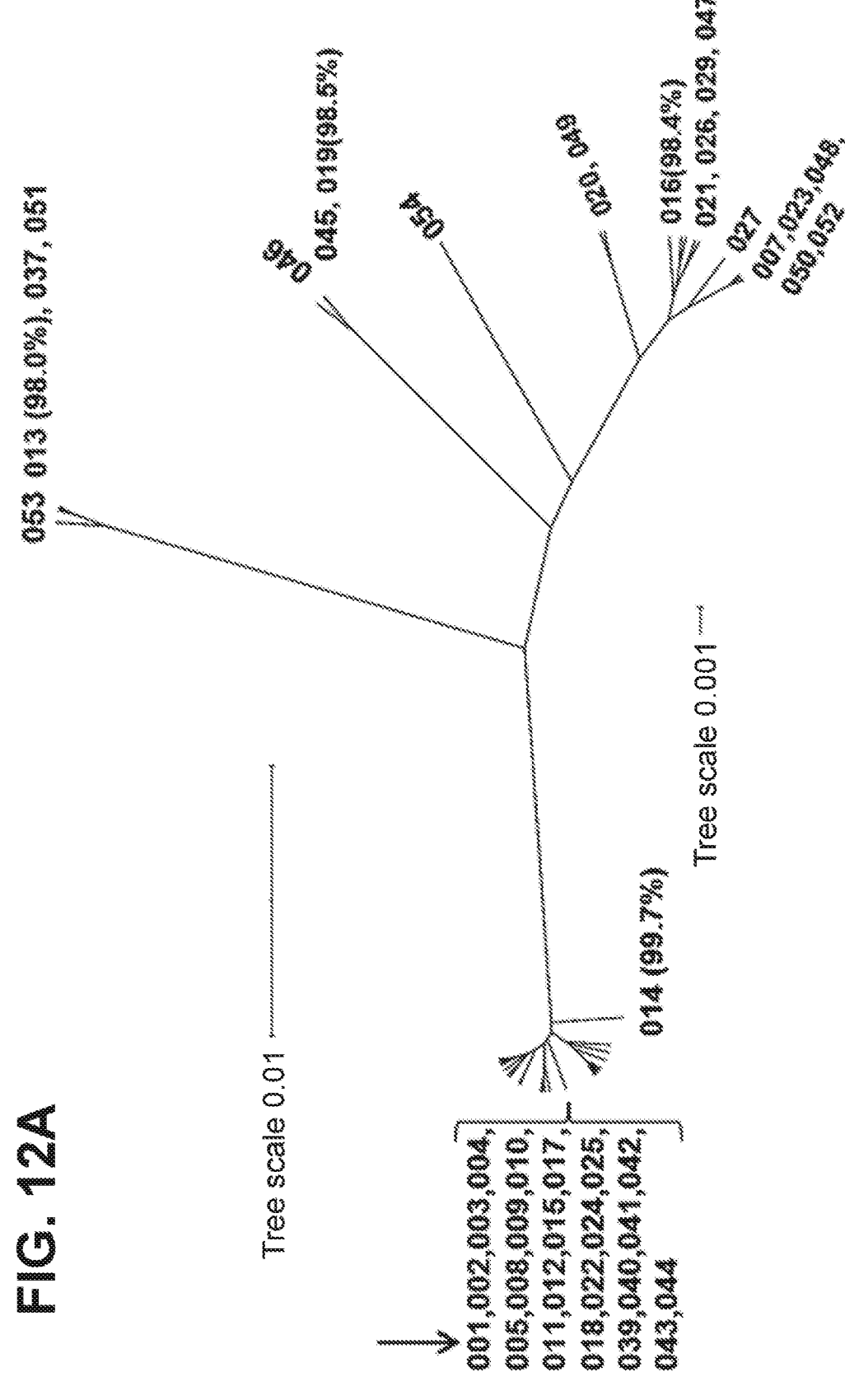

Nucleotide sequence corresponding to tcdA and tcdB was extracted from the WGS data and used to generate the deduced amino acid sequence of TcdA and TcdB protein variants, respectively. To serve as a point of reference, the TcdA and TcdB proteins coded for by strain CD630 are variants TcdA001 and TcdB001. A total of 43 unique TcdA variants that differ from variant TcdA001 were identified. All TcdA variants were closely related, with pairwise amino acid sequence identity to TcdA001 that ranged from 98.0% to >99.9%. From the deduced amino acid sequence of TcdA variants, an unrooted phylogenetic tree was constructed using the UPGMA (FIG. 12A). Four clusters of TcdA variants can be identified on the UPGMA tree. TcdA001 is grouped together with 21 other TcdA variants, with each variant sharing >99.7% amino acid sequence identity with TcdA001. Of the TcdA variants whose ORF is at least 2,710 amino acids in length, TcdA013 was the most diverse (98.0% sequence identity with TcdA001). Variant TcdA007 (98.2% sequence identity with TcdA001) formed a cluster with several other full-length variants. Finally, TcdA019 which shares 98.5% identity with TcdA001, is representative of a fourth cluster on the TcdA phylogenetic tree. Most of the sequence variation among the 44 TcdA variants is due to single amino acid substitutions. The greatest amino acid sequence diversity among the TcdA variants is found within the CROP domain of the proteins (Table 8). The tcdA nucleotide sequence of several isolates predict ORFs that are shorter than TcdA001 (summarized in. Table 10). A termination codon in the TcdA sequence from 14 isolates occurs following amino acid residue 46 (p.Q47*). While these isolates were collected in different geographic regions, including the US and multiple European countries, each is genotyped as ST37/RT017. The tcdA sequence of three additional isolates also predicted termination codons within the GTD domain of the toxin (p.V57*, p.D108*, p.P196*). A common termination codon (p.G699*) in the APD domain is shared by three isolates. Since the predicted TcdA ORFs of these 20 isolates lack at least 3 of the functional toxin domains, TcdA variants were not assigned. Novel TcdA variants were assigned for 5 isolates whose tcdA sequence predict a deletion of a portion of the CROP domain of the toxin. In-frame deletions of 33 (TcdA050) and 175 amino acids (TcdA051) were detected in two isolates, while three isolates had termination codons in the TcdA CROP domain (TcdA052, TcdA053, TcdA054). Critical catalytic residues within the GTD (D285 and D287) and APD domains (C700) of the toxins are conserved among each of the 44 unique TcdA variants.

There were 31 non-toxigenic isolates, lacking any sequence corresponding to TcdA and TcdB (TcdA–/TcdB–). These were not restricted to a single ST or RT. A subset of 3 strains code for a full length TcdB variant, but without any tcdA sequence (TcdA–/TcdB+). These TcdA–/TcdB+ strains were also associated with multiple ribotypes. Precedent for both TcdA–/TcdB+ as well as non-toxigenic TcdA–/TcdB- *C. difficile* strains is well established in the literature.

Figure 12B:
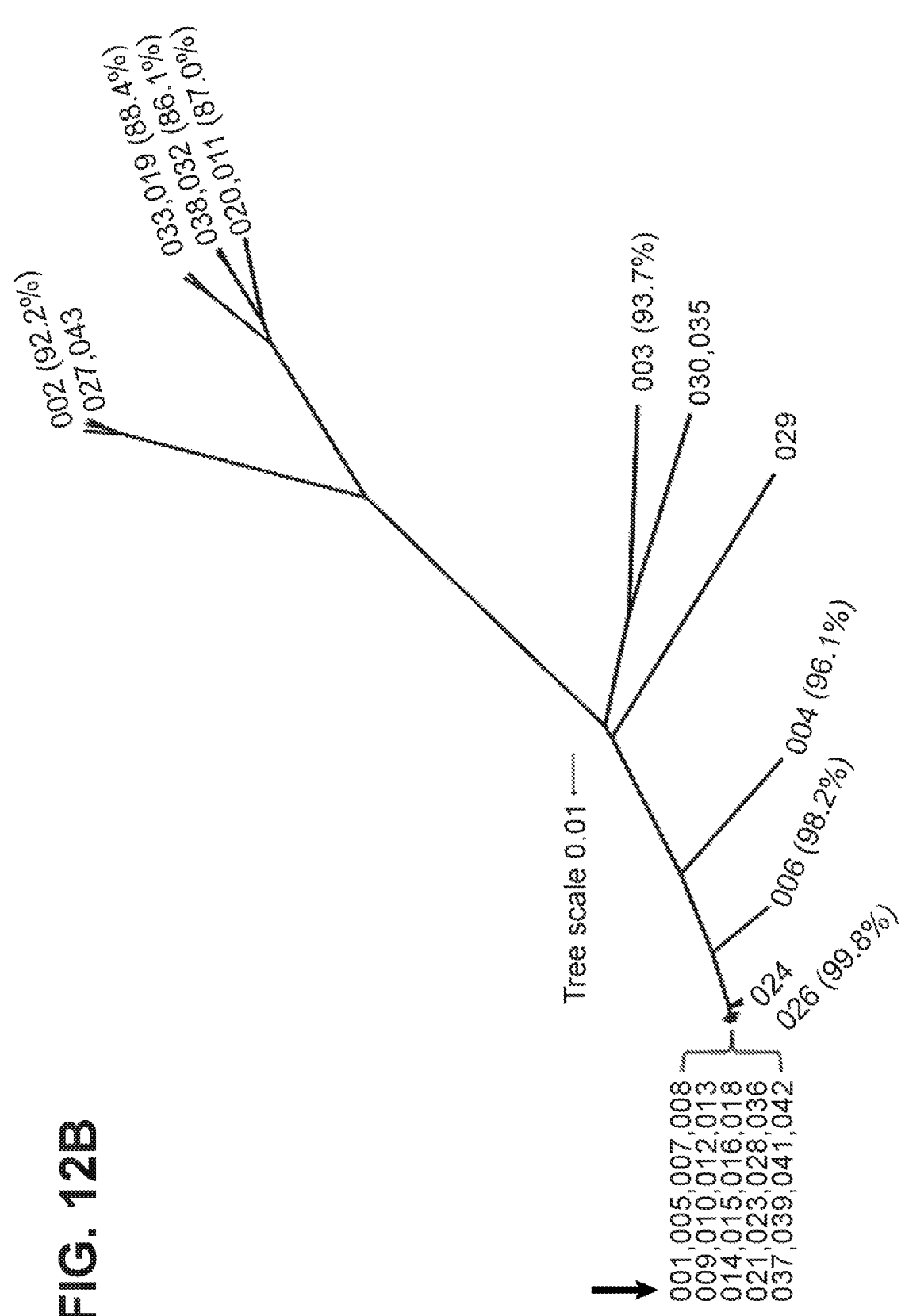

The amino acid sequences of TcdB variants were more diverse than TcdA. Of the 36 variants that differed from TcdB001, pairwise amino acid sequence identity with TcdB001 ranged from 86.1% to >99.9%. This is illustrated in the phylogenetic tree of TcdB variants (FIG. 12B). A cluster of 19 variants group together with TcdB001 (>99.8% pairwise sequence identity). Variants TcdB032 and TcdB038 are the most diverse, sharing 86.1% and 86.2% sequence identity with TcdB001, respectively. TcdB032 is detected in one isolate in the collection (typed as ST62 and RT591) and two isolates code for TcdB038 (ST567 and RT095). While sequence diversity is detected in each of the functional domains of the TcdB toxin, the greatest diversity is found within the GTD domain (Table 8). Unlike TcdB001, eleven of the TcdB variants have a lysine inserted in the GTD domain (p.Val307_Thr308insLys). Based on the structure of the TcdB GTD domain (PDB ID 2BVM), this additional amino acid residue is not predicted to impact the conformation of the GTD domain. The eleven sequence variants that contain the additional amino acid cluster to two groups on the TcdB phylogenetic tree (FIG. 12B). Critical catalytic residues of GTD (D286 and D288) and autoprotease (C698) domains are conserved among all TcdB variants. Although the TcdA and TcdB toxins share similar architectural homology with respect to the functional domains of the molecules, the pairwise amino acid sequence identity between TcdA001 and TcdB001 is only 42%.

Phylogenomic Analysis and the Association of *C. difficile* Epidemiological Markers with Toxin Variant Type.

The 478 *C. difficile* genomes were assembled to construct a phylogenomic tree using Parsnp. The nucleotide sequence of isolate CD630 was used as the reference genome. Each branch of the dendrogram is representative of a *C. difficile* isolate. Metadata descriptive of each isolate, including Glade, ST, ribotype and toxin variant type, has been added as concentric rings to the circumference of the phylogenomic tree. Included among the 478 isolates are 61 ribotypes and 71 sequence types (STs). Comparative analysis afforded by the figure helps to illustrate that these epidemiological markers are not predictive of toxin variant type. Starting at 12 o'clock on the tree and traveling counterclockwise to 10 o'clock is a cluster of 108 isolates that are typed as ST1 and all code for TcdB variant TcdB002. Although most isolates in this cluster are ribotype 027, other ribotypes such as 003, 014/020, 081, 176, 027/198, and 198 are also identified. Continuing counter-clockwise on the tree is a cluster of 42 isolates that are typed as ST11 and code for TcdB variant TcdB004. Despite sharing considerable phylogenomic, ST and TcdB variant type similarities, the ribotype variability among these isolates is considerable, including ribotypes 045, 078, 126, 078/126 and 413.

Among the numerous methods that have been developed for molecular typing of *C. difficile* isolates, ribotype is most commonly cited. Analysis of WGS data in this study illustrates that isolates grouped by ribotype code for sequence-diverse toxin variants (Table 9). Among the 21 isolates that are grouped as ribotype 078/126, genes coding for three TcdA variant types (TcdA013, TcdA015, TcdA046) were identified. The ribotype 078/126 isolates also code for three TcdB variants (TcdB004, TcdB006, TcdB012) whose amino acid sequence identity to TcdB001 ranges from 96.1% to 99.9%. Ribotype 014/020 isolates in the collection code for seven unique TcdA and eight TcdB variants. The pairwise identity of the eight TcdB variants to TcdB001 ranges from 92.2% to 99.9%. These examples illustrate that isolate classification by ribotype is not representative of the diversity of toxin protein sequences. Prediction of the breadth of the functional immune response to a toxin-based vaccine antigen needs to be framed in the context of toxin variant type and not strain ribotype.

Figure 13:
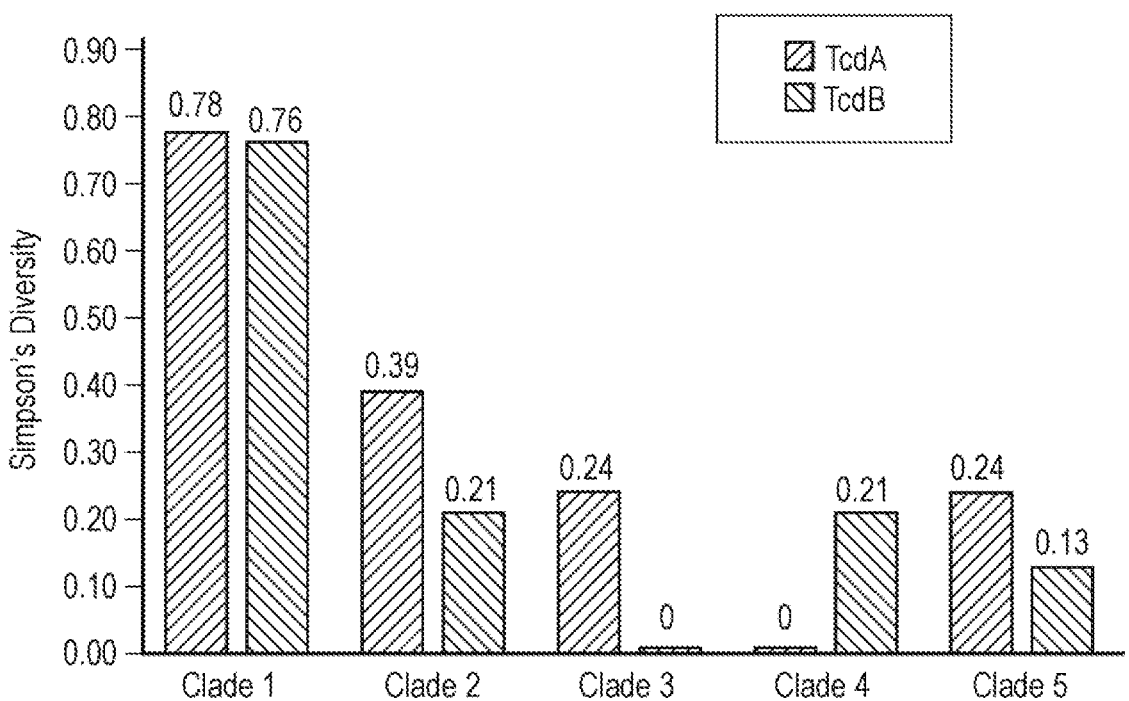
FIG. 13—With the exception of Glade 4, the number and distribution of TcdA variants within each of the clades is more diverse than TcdB variants (FIG. 13).

Using ST assignments, all but two of the isolates from this study could be grouped into one of five clades. With the exception of Glade 4, the number and distribution of TcdA variants within each of the clades is more diverse than TcdB variants (FIG. 13).

Discussion

CDI is a worldwide public health issue and is now the most common healthcare-associated bacterial pathogen. It was estimated that during 2011 there were nearly half a million cases of CDI in the US, associated with approximately 29,000 deaths. Although most patients experiencing a first episode of CDI respond well to standard antibiotic treatment, approximately 15% to 35% of patients suffer from at least one recurrence. Several vaccine strategies for the prevention of CDI have been, or are currently, being evaluated in clinical trials and most of these have focused on the large single subunit glucosylating toxins, TcdA and TcdB as antigens. Clinical proof of concept for the selection of these toxins as *C. difficile* vaccine antigens has come from studies that were used to support the approval of Bezlotoxumab (ZINPLAVA™, Merck) to reduce the recurrence of CDI in adult patients. Bezlotoxumab is a human monoclonal antibody that binds to a discontinuous epitope located within the CROP domain of TcdB. Since the CROP domain accounts for approximately 20% of the entire protein, a prophylactic vaccine approach able to generate a functional polyclonal response to additional and multiple epitopes across the entire toxin has the potential to prevent primary disease. Three prophylactic vaccines composed of full-length toxin open reading frames, or portions thereof, have been evaluated in clinical studies. A recombinant fusion protein that includes a portion of the TcdA and TcdB CROP domain from a single strain of *C. difficile* has completed phase 2 testing (NCT02316470). The antigens included in the other investigational vaccines correspond to inactivated full length toxin proteins (i.e., toxoids TxdA and TxdB). Following a planned interim analysis in a phase 3 clinical study for one of the toxoid based vaccines (NCT01887912), the study was discontinued based on the low probability of meeting its primary objective. A bivalent toxoid-based vaccine composed of genetically and chemically inactivated toxoid antigens is in phase 3 clinical development (NCT03918629). Active immunization with these genetically and chemically modified full length versions of TcdA and TcdB has elicited a robust polyclonal antibody response in subjects 65-85 years of age.

Several molecular methods have been utilized to characterize *C. difficile* toxin genes for epidemiological analysis of CDI. Two of these, toxinotype and the deduced amino acid sequence of the Receptor Binding Domain (RBD) of TcdB variants, have focused on toxin genotype of *C. difficile* isolates. However, neither method provides detailed insight into the sequence diversity of the complete open reading frame of the two large toxin proteins. An understanding of the toxin variants expressed by CDI isolates is critically important for an assessment of the breadth of the functional antibody response elicited following immunization with a bivalent toxoid vaccine. Demonstration that the polyclonal immune sera can neutralize the cytotoxicity of sequence diverse toxins is required for an evaluation of vaccine efficacy.

The availability of *C. difficile* WGS data with deep sequence coverage, across the PaLoc in particular, is limited. In a recent study, analysis of WGS data from 906 *C. difficile* strains focused on questions related to bacterial adaptation for healthcare-mediated transmission, but did not investigate the diversity of the tcdA and tcdB alleles. The WGS of 478 *C. difficile* isolates have been determined in our study. Acceptance criteria for toxin variant assignment required greater than 35× coverage across both tcdA and tcdB with less than 10% sequence heterogeneity at any nucleotide position for at least one representative isolate. A total of 44 unique TcdA variants and 37 unique TcdB variants were identified, many of which had not previously been reported. The toxin variants with pairwise amino acid sequence identity furthest removed from TcdA001 and TcdB001 were TcdA013 (98% sequence identity) and TcdB032 (86.1% sequence identity), respectively. The ability of the immune response elicited by a toxoid antigen to neutralize the cytotoxicity of sequence diverse toxins remains to be experimentally tested. It should be noted that the origin of the *C. difficile* isolates evaluated in this study was largely restricted to North America and Europe. The TcdA and TcdB sequences of isolates from different geographic regions may uncover further toxin diversity. In addition, as the isolates collected in this study are not prevalence based the most frequent TcdA and TcdB variant types identified here may not be representative of prevalence among circulating CDI isolates.

Although both TcdA and TcdB play a role in CDI, several observations suggest that TcdB is the major virulence factor. In both murine and hamster models of *C. difficile* infection, TcdB was responsible for most of the intestinal damage whereas TcdA caused more superficial and localized damage. It is also worth noting that TcdA+/TcdB− *C. difficile* strains are extremely rare, whereas TcdA−/TcdB+ strains are not uncommon and have been associated with multiple disease outbreaks. The greater amino acid sequence diversity noted among the 37 TcdB variants compared with the 44 TcdA variants identified in this study could in part be the consequence of host immune pressure applied to the more virulent TcdB toxins.

Several isolates with deduced amino acid sequences shorter than TcdA001 have been identified in this collection. The majority of these are the product of in-frame stop codons in the glucosyl transferase or auto protease domains and therefore are not likely to code for a functional toxin. TcdA variants with either a deletion or a termination codon within the CROP domain have also been identified. Cell-culture based cytotoxicity assays are required to demonstrate whether these TcdA variants are functional. Previous work by Rupnik and Janezic has indicated that toxinotype VI and VII strains, with deletions in the CROP domain, do produce functional TcdA. It has also been reported that a TcdA mutant lacking the entire CROP domain is cytotoxic, able to enter human cells and cause cytotoxicity, albeit with reduced uptake. Among the isolates evaluated in this study, similar genetic changes in the sequences corresponding to the CROP domain of TcdB variants have not been identified. The larger number and length of repeat units in the TcdA CROP domain may render this locus more prone to genetic rearrangements than TcdB. Differences between the genes coding for the two toxins extend beyond the CROP domain Examples of toxigenic isolates lacking any sequence coding for TcdA (TcdA−/TcdB+) are included in this collection and have been described in the literature. As noted earlier and despite their close proximity in the PaLoc, examples of TcdA+/TcdB− isolates, lacking tcdB sequences are not common. Our current understanding of the molecular detail of epithelial cell binding and uptake also differentiates the toxins from one another. Taken together, these observations suggest that evolution of the two toxins has been and will continue to be subject to different selection pressures. Relative to the highly conserved TcdA variants, the greater sequence diversity among TcdB variants described in this manuscript is consistent with this hypothesis.

The same acceptance criteria for deep sequence coverage were applied in the analysis of WGS data corresponding to the genes coding for both subunits of the *C. difficile* binary toxin. More than half of the isolates (n=292, 61%) in this study did not code for binary toxin (e.g., genotyped as cdt4−/cdtB−). Consistent with literature reports indicating that CDI isolates typed as TcdA−/TcdB−/CDT+ are rare, there were no TcdA−/TcdB−/CDT+ isolates among the isolates evaluated in this study. A study in a hamster model of CDI suggested that vaccination with bivalent TxdA and TxdB antigens did not fully protect from challenge with a TcdA+/TcdB+/CDT+ NAP1 strain and that the addition of binary toxin antigens to the vaccine greatly enhanced protection. Interestingly, human epidemic isolates 027/BI/NAP1 and 078/BK/NAP7 are both positive for binary toxin, whereas the emerging RT106 as well as RT017 isolates common in Asia are negative for binary toxin. The contribution of the binary toxin to clinical CDI remains controversial.

Based on ST assignments, *C. difficile* isolates have been grouped into five different clades. Dingle et al. showed that 17 alleles coding for 13 deduced peptide sequences corresponding to the TcdB RBD segregate in parallel with Glade assignment. That is, no single RBD allele was found in more than one Glade. However, this study focused on just a small section of TcdB and did not capture the full sequence diversity of TcdB variants. In addition, the diversity of TcdA has not been taken into consideration. Using ST assignments from WGS data collected in our study, 476 of the 478 isolates can be placed into one of the 5 clades. Greater than half of the isolates (n=275) are grouped into Clade 1 and these are genotypically diverse, including 49 different STs, 39 ribotypes, 24 TcdA variants and 23 TcdB variants. However, much like the Glade-restricted observation for the RBD alleles, none of the 24 TcdA and 23 TcdB variants are coded for by strains other than those grouped to Glade 1. The same conclusion can be drawn for strains associated with each Glade. For example, while Glade 5 strains are fewer in number (n=45) and much less diverse (42 of these are ST11 and each code for TcdB004), all TcdA013 and TcdB004 variants are coded for by strains that are grouped to Glade 5.

The Simpson's Diversity Index (SDI) analysis indicated that the distribution of TcdA variants within the respective clades is generally more diverse than the variants of TcdB. Although both TcdA and TcdB are co-localized to the PaLoc, the variation in SDI suggested that TcdA and TcdB might have evolved in response to different evolutionary pressures. One interpretation is that point mutations in TcdA are sporadic and equally represented across phylogenetic clades (excluding Glade 4 in this collection of strains). The variability noted among TcdB protein sequences can be postulated as the sum of sporadic point mutations together with pressure exerted from additional mechanisms. It is interesting to note that while three distinct cell surface receptors for TcdB have been identified, (PVRL3 (or NECTIN3), CSPG4 and members of the Frizzled protein family), similar molecular binding detail has not been uncovered for TcdA. In fact, none of these receptors bind TcdA. Instead, the CROP domain of TcdA showed high affinity association with glycans, whereas the CROP domain of the TcdB does not bind glycans. The molecular difference in host cell entry mechanisms utilized by TcdA and TcdB may contribute to the variation of SDI noted here.

To our knowledge, this is the first comprehensive WGS characterization of a large *C. difficile* isolate collection with a focused analysis of the sequence diversity among TcdA and TcdB toxins. From WGS data, we identified 44 TcdA variants and 37 TcdB variants, many of which were not previously documented. The relative lack of deep WGS data deposited in public databases could be due to technical challenges associated with the sequencing of *C. difficile* isolates using conventional methods, and in particular sequence determination across repetitive regions of the pathogenicity locus. We observed that neither ribotype nor ST assignment is predictive of the toxin genotype of *C. difficile* isolates. Specifically, isolates that are grouped together based on ribotype assignment can code for multiple sequence diverse TcdA and TcdB variants. We propose an amended nomenclature that describes both the ribotype and the TcdA and TcdB variant type for the purpose of *C. difficile* strain surveillance during vaccine efficacy trials. As the immune response to toxoid antigens will be polyclonal and not restricted to the RBD, it is essential that sequence diversity of the entire toxin proteins be considered in efforts to estimate vaccine efficacy. While challenges are associated with obtaining deep sequence coverage across the pathogenicity locus, WGS should be applied for *C. difficile* isolate typing together with ribotype determination to better guide *C. difficile* epidemiological studies and to help evaluate immunological approaches for the prevention of *C. difficile* disease.

TABLE 7

| | Collection | | Molecular | Number of |
|---|---|---|---|---|
| Collection Name | Year | Geographic Origin | Typing | Isolates |
| | | *C. difficile* isolates included in this study. | | |
| Legacy North America | 2004-2009 | USA, Canada | Ribotype, WGS | 24 |
| Legacy UK | <2011 | UK | Ribotype, WGS | 26 |
| Antimicrobial Testing Leadership and Surveillance (ATLAS) | 2009-2017 | Belgium, Czech Republic, France, Germany, Hungary, Spain, Sweden | Ribotype, WGS | 303 |
| Toxinotype diversity subset | 2009-2016 | Australia, Belgium, Germany, Slovenia, Spain, UK | Ribotype, Toxinotype, WGS | 64 |
| US contemporary | 2015-2018 | USA | Ribotype, WGS | 87 |

TABLE 8

Pairwise amino acid sequence identity (%) of a subset of diverse
TcdA and TcdB variants to TcdA001 and TcdB001, respectively.

| TcdA Variant | Entire Protein | Glucosyl Transferase | Auto Protease | Cell Entry | Binding (CROP) |
|---|---|---|---|---|---|
| TcdA013 | 98.0 | 99.5 | 99.2 | 98.6 | 96.1 |
| TcdA007 | 98.2 | 99.5 | 99.6 | 98.6 | 96.5 |
| TcdA020 | 98.2 | 99.5 | 99.6 | 98.8 | 96.3 |
| TcdA019 | 98.5 | 99.6 | 99.2 | 99.0 | 96.8 |
| TcdA014 | 99.7 | 100 | 100 | 99.6 | 99.7 |

TABLE 8-continued

Pairwise amino acid sequence identity (%) of a subset of diverse
TcdA and TcdB variants to TcdA001 and TcdB001, respectively.

| TcdB Variant | Entire Protein | Glucosyl Transferase | Auto Protease | Cell Entry | Binding (CROP) |
|---|---|---|---|---|---|
| TcdB032 | 86.1 | 79.2 | 90.2 | 87.9 | 87.6 |
| TcdB011 | 87.0 | 79.4 | 90.2 | 89.4 | 88.4 |
| TcdB019 | 88.4 | 79.2 | 90.6 | 91.7 | 90.4 |
| TcdB002 | 92.2 | 96.5 | 97.3 | 90.6 | 88.4 |
| TcdB003 | 93.7 | 79.0 | 90.6 | 99.2 | 99.4 |
| TcdB015 | 99.8 | 100 | 100 | 99.9 | 99.4 |

TABLE 9

*C difficile* isolates grouped by ribotype can code for
multiple and sequence diverse TcdA and TcdB variants.

| Ribotype | TcdA variants | TcdB variants |
|---|---|---|
| 027 (96) | 002 (3), 007 (81), 018 (1), 023 (1), 048 (8), 050 (1), 052 (1) | 002 (92), 008 (3), 010 (1) |
| 001 (40) | 010 (35), 014 (1), 015(1), 018 (1) | 001 (1), 012 (35), 021 (1), 036 (1) |
| 078 (11) | 013 (11) | 004 (11) |
| 002 (21) | 010 (21) | 012 (21) |
| 003 (7) | 007 (1), 018 (5), 022 (1) | 001 (1), 002 (1), 010 (3) |
| 013 (6) | 009(1), 010 (1), 014 (3), 025 (1) | 008 (1), 012 (1), 013 (1), 021 (3) |
| 053 (8) | 001 (1), 012 (5), 039 (1) | 001 (2), 008 (5) |
| 056 (21) | 003 (4), 008 (2), 011 (11), 014 (1), 042 (1) | 008 (2), 012 (5), 015 (12), 026 (1), 037 (1) |
| 070 (5) | 015 (5) | 012 (5) |
| 106 (16) | 002 (14), 010 (1), 024 (1) | 009 (13), 023 (1), 024 (1), 042 (1) |
| 126 (10) | 013 (10) | 004 (10) |
| 258 (2) | 010 (1), 011 (1) | 015 (1), 026 (1) |
| 078/126 (21) | 013 (18), 015 (2), 046 (1) | 004 (18), 006 (1), 012 (2) |
| 014/020 (52) | 003 (4), 005 (2), 007 (1), 009 (1), 010 (41), 015 (1), 043 (1) | 001 (4), 002 (1), 007 (4), 008 (3), 012 (36), 014 (1), 028 (1), 039 (1) |
| 018/356 (13) | 002 (7), 010 (2), 017 (4) | 009 (7), 012 (2), 016 (4) |

TABLE 10

*C difficile* isolates with atypical TcdA sequence characteristics.

| Isolate ID | Clade | ST | Ribotype | TcdA Assignment | Descriptive Nomenclature | TcdB Variant |
|---|---|---|---|---|---|---|
| PFECD0010 | 4 | 37 | 017 | truncated | p.Q47* | TcdB003 |
| PFECD0009 | 4 | 37 | 017 | truncated | p.Q47* | TcdB003 |
| PFECD0083 | 4 | 37 | 017 | truncated | p.Q47* | TcdB003 |
| PFECD0086 | 4 | 37 | 017 | truncated | p.Q47* | TcdB003 |
| PFECD0090 | 4 | 37 | 017 | truncated | p.Q47* | TcdB003 |
| PFECD0093 | 4 | 37 | 017 | truncated | p.Q47* | TcdB003 |
| PFECD0099 | 4 | 37 | 017 | truncated | p.Q47* | TcdB003 |
| PFECD0243 | 4 | 37 | 017 | truncated | p.Q47* | TcdB003 |
| PFECD0269 | 4 | 37 | 017 | truncated | p.Q47* | TcdB003 |
| PFECD0275 | 4 | 37 | 017 | truncated | p.Q47* | TcdB003 |
| PFECD0342 | 4 | 37 | 017 | truncated | p.Q47* | TcdB003 |
| PFECD0349 | 4 | 37 | 017 | truncated | p.Q47* | TcdB003 |
| PFECD0391 | 4 | 37 | 017 | truncated | p.Q47* | TcdB003 |
| PFECD0396 | 4 | 37 | 017 | truncated | p.Q47* | TcdB003 |
| PFECD0292 | 2 | 1 | 176 | truncated | p.V57* | TcdB002 |
| PFECD0300 | 4 | 37 | 017 | truncated | p.D108* | TcdB003 |
| PFECD0106 | 5 | 11 | 045 | truncated | p.P196* | TcdB004 |
| PFECD0140 | 2 | 62 | 591 | truncated | p.G699* | TcdB032 |
| PFECD0187 | 2 | 567 | 095 | truncated | p.G699* | TcdB038 |
| PFECD0192 | 2 | 567 | 095 | truncated | p.G699* | TcdB038 |
| PFECD0186 | 2 | 1 | 027 | TcdA050 | p.Val2163_Leu2195del | TcdB002 |
| PFECD0234 | 5 | 11 | 413 | TcdA051 | p.Val2211_Phe2385del | TcdB004 |
| PFECD0523 | 2 | 1 | 027 | TcdA052 | p.Y2172* | TcdB002 |
| PFECD0111 | 5 | 11 | 045 | TcdA053 | p.Y2172* | TcdB004 |
| PFECD0203 | 1 | 3 | 023 | TcdA054 | p.G2327* | TcdB041 |

Example 9

Randomized Studies of Two *Clostridioides* (*clostridium*) *Difficile* Vaccine Formulations Background Two formulations of investigational bivalent *Clostrithoides* (*Clostridium*) *difficile* vaccine (QS-21 adjuvanted toxoid and toxoid-alone, i.e., in the absence of adjuvant) were assessed for safety and immunogenicity in randomized studies in healthy adults 50-85 years of age. Each investigational bivalent vaccine includes a mixture of genetically modified *C. difficile* toxoid A, i.e., polypeptide, (comprising SEQ ID NO: 4, wherein the initial methionine is not present) and genetically modified *C. difficile* toxoid B, i.e., polypeptide. (comprising SEQ ID NO: 6, wherein the initial methionine is not present) that were further chemically inactivated by 1-ethyl-3-(3-dimethylaminopropyl) carbodiimide) (EDC) and N-Hydroxysuccinimide (NHS).

Methods

The Phase 1 study of QS-21 adjuvanted toxoid vaccine randomized subjects 3:1 to 100 μg QS-21-containing *C difficile* vaccine or placebo: 3 doses were given according to 2 different schedules: a shortened month (Months 0, 1, 3) or day (Days 1, 8, 30) regimen. The Phase 2 toxoid-alone vaccine study randomized subjects 3:3:1 to receive 100 or 200 μg unadjuvanted *C difficile* vaccine formulation or placebo in Stages 1 and 2 (sentinel cohorts of different age groups), and 3:1 to receive the selected dose of unadjuvanted *C difficile* vaccine formulation or placebo in Stage 3. Three doses were given on a day (Days 1, 8, 30) regimen. Safety was the primary outcome for both studies. Immunogenicity was determined by measuring serum toxin A- and B-specific neutralizing antibodies.

Results

In the day regimen, 10 reports across both studies of grade 3 injection site redness postdose 2 triggered predefined stopping rules. Local reactions in both studies were more common among vaccine versus placebo recipients. Injection site pain predominated and was generally mild in severity. Systemic events were infrequent and generally mild-to-moderate in severity. Adverse events were reported by 50.0%-75.0% and 16.7%-50.0% of subjects in the QS-21 and toxoid-alone studies, respectively. Immune responses peaked around Day 37 (shortened-month regimen) or between Day 15 and Month 2 (day regimen), and remained above baseline throughout follow-up.

Overall, 184 subjects were randomized in the QS-21 study, including 32 subjects in the 50-to 64-year age cohort shortened-month regimen who received 2 doses, 32 subjects in the 50- to 64-year age cohort day regimen who received 2 doses, and 120 subjects in the 65- to 85-year age cohort shortened-month regimen who received 1 dose.

In the toxoid-alone study. 184 subjects were randomized, including 41 and 28 subjects in the 50- to 64-year and 65- to 85-year age cohorts, respectively, who received all 3 doses. Demographics are shown in In both studies, geometric mean concentrations (GMCs) increased after vaccination in the active vaccine group(s) and remained elevated throughout the immunogenicity follow-up period. See FIGS. 15A-F and FIGS. 16A-D. The toxoid-alone study had more extensive immunogenicity data available compared with the QS-21 study; a number of subjects in the toxoid-alone study received all 3 doses, and immune responses were evaluated through 12 months postdose 3. See FIGS. 16A-D.

Conclusion

Both formulations demonstrated robust immunogenicity. However, both studies stopped early due to grade 3 injection site redness postdose 2 of the day (Days 1, 8, 30) regime neither formulation progressed to later stage development. Instead, an aluminum hydroxide-containing formulation of the vaccine candidate administered at 0, 1, and 6 months, which was safe and immunogenic in phase 1 and 2 studies, advanced to phase 3 studies.

Example 10

Immunogenicity, Safety and Tolerability of a Booster Dose of *Clostridium difficile* Vaccine and 4 Year Antibody Persistence Background: *Clostridioides difficile* (*C difficile*) is a common cause of antibiotic-associated diarrhea. To date, there is no vaccine available to prevent *C. difficile* infection (CDI). In this extension of a phase 2 study we explored the immunogenicity, safety, and tolerability of a booster dose (Dose 4), in addition to the antibody persistence of a three-dose regimen of toxoid-based *C difficile* vaccine in 300 healthy adults 65 to 85 years of age in the United States.

Methods: The first stage of this study was conducted from 16 Jul. 2015 to 7 Mar. 2017. Subjects in the first stage were enrolled and randomized to receive one of two antigen dose levels (100 μg or 200 μg total toxoid A and B) or placebo, administered in one of two three-dose regimens: Days 1, 8 & 30 (Day regimen) or Month 0, 1 & 6 (Month regimen). Immunogenicity testing was conducted on blood samples obtained at each of nine study visits through 12 months post dose 3. In the extension stage, subjects who had received active vaccine in the first stage were re-randomized at 12 months post dose 3 to receive either a booster dose (of the same dose and regimen as received originally) or placebo in a 1:1 ratio. Subjects were followed for immunogenicity three (3) years post booster (four years post dose #3)

Results: Peak functional antibody immune response to vaccination was observed between day 8 (in the Day regimen) and 30 (in the Month regimen) following booster administration. Post booster, both regimens demonstrated robust anamnestic responses with peak antibody levels above the three-dose peak (stage 1) for both toxin A and toxin B. Toxin A geometric mean concentrations (GMCs) remained above pre-booster GMCs, 3 years post booster for both dose levels and regimens. Antibody persistence for both regimens and dose groups demonstrated stable antibody levels four years after the primary vaccination series among subjects who did not receive a booster dose. No Grade 4 local or systemic reactogenicity was reported during the study. Pain was the most common local reaction reported. Adverse event rates per subject were similar between both regimens, dose levels and between vaccination and placebo. There were no Serious Adverse Events (SAEs) considered related to the investigational product at any dose or regimen. The safety profile was consistent with what was seen in the first stage of the study Results: A booster dose (dose 4) of *Clostridioides difficile* vaccine candidate is highly immunogenic, well tolerated and demonstrates an acceptable safety profile in both the 100 μg and 200 μg dose groups for the Day and the Month regimens. Antibody persistence remains stable from 12 months to 4-year post dose 3.

Example 11

**Demonstration that a Bivalent Toxoid Vaccine is able to Induce Antibodies in Humans that can Neutralize the Diversity of *Clostridioides difficile* Toxins TCDA and TCDB**

Figure 14:
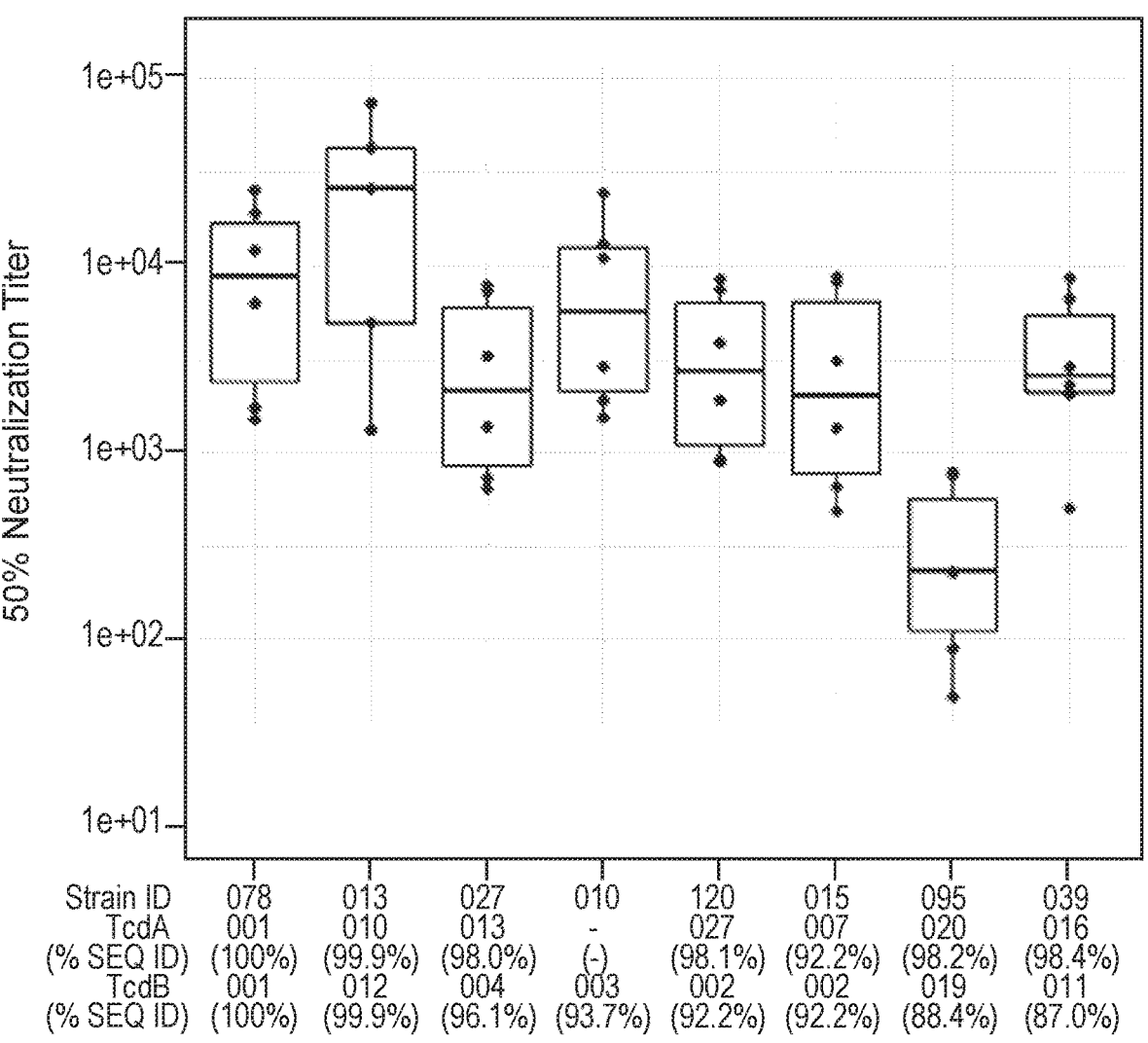
FIG. 14—Human immune sera are able to neutralize sequence diverse *C. difficile* toxins.
Figure 15A:
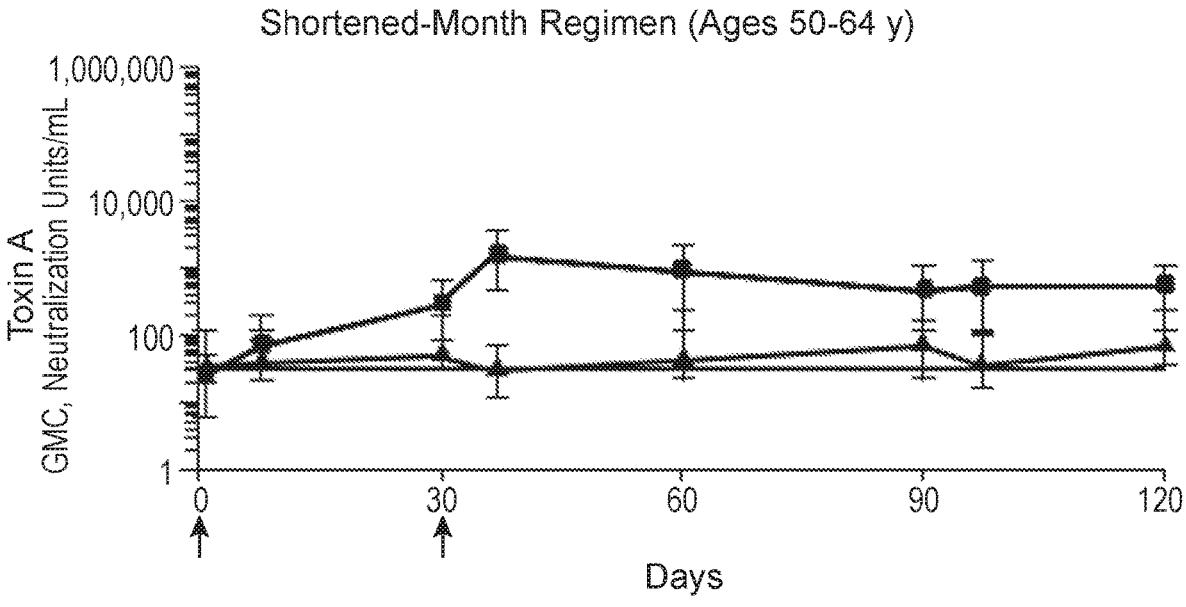
FIG. 15A-F—In both studies, geometric mean concentrations (GMCs) increased after vaccination in the active vaccine group(s) and remained elevated throughout the immunogenicity follow-up period. See graphs FIG. 15A depicting GMC, Neutralization Units/mL against *C. difficile* Toxin A in subjects administered with QS-21 on a Shortened-Month Regimen (Ages 50-64 y)
Figure 15B:
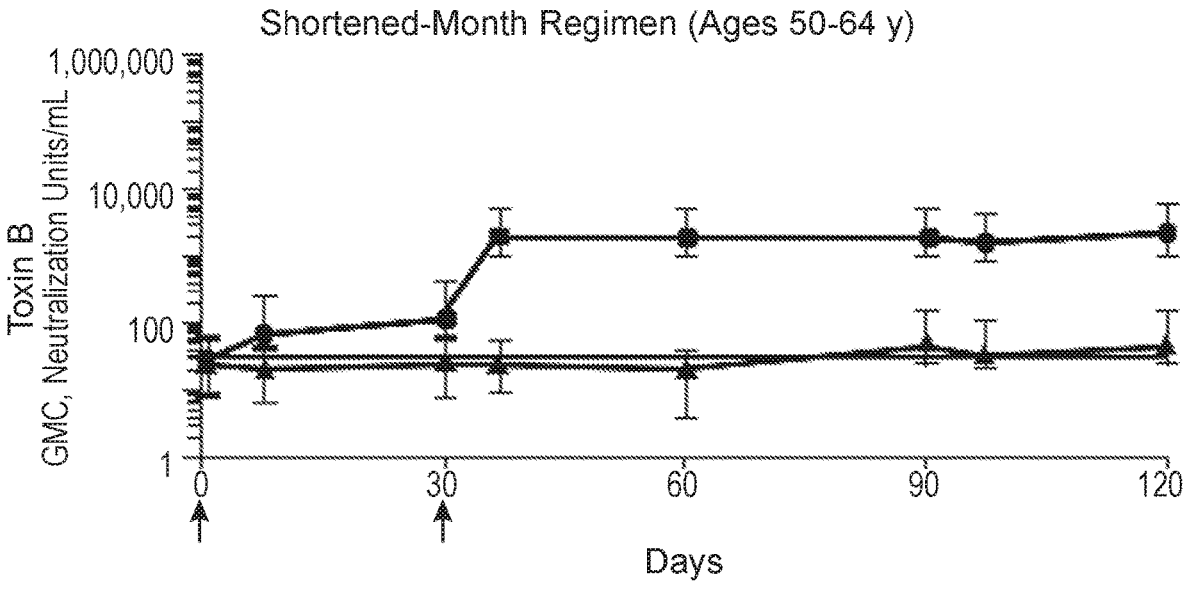
Figure 15C:
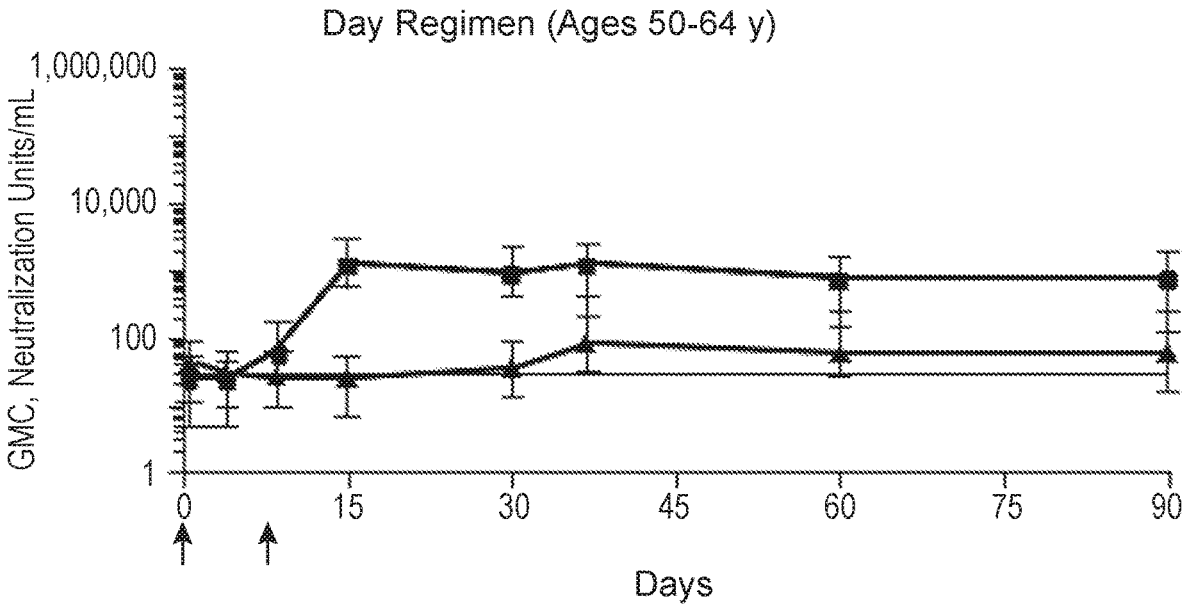
Figure 15D:
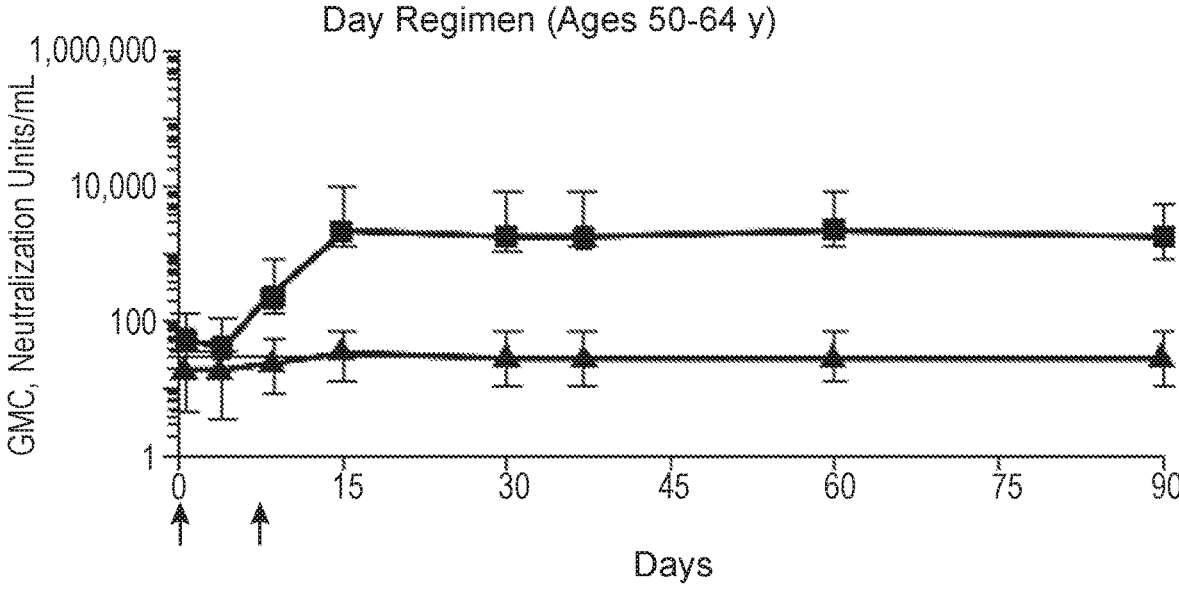
Figure 15E:
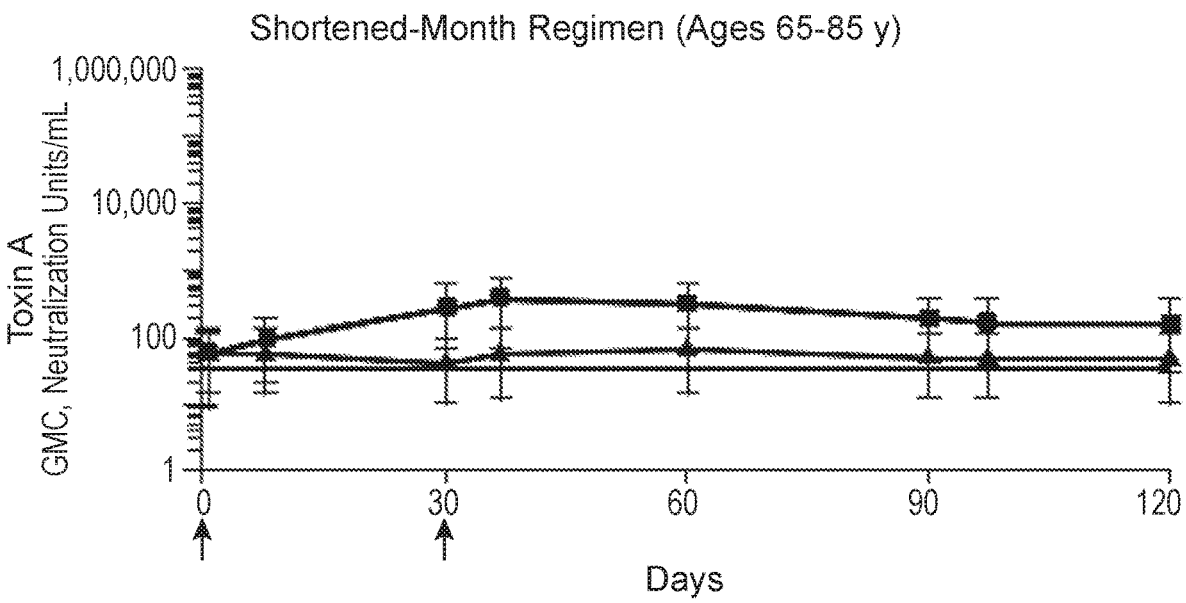
Figure 15F:
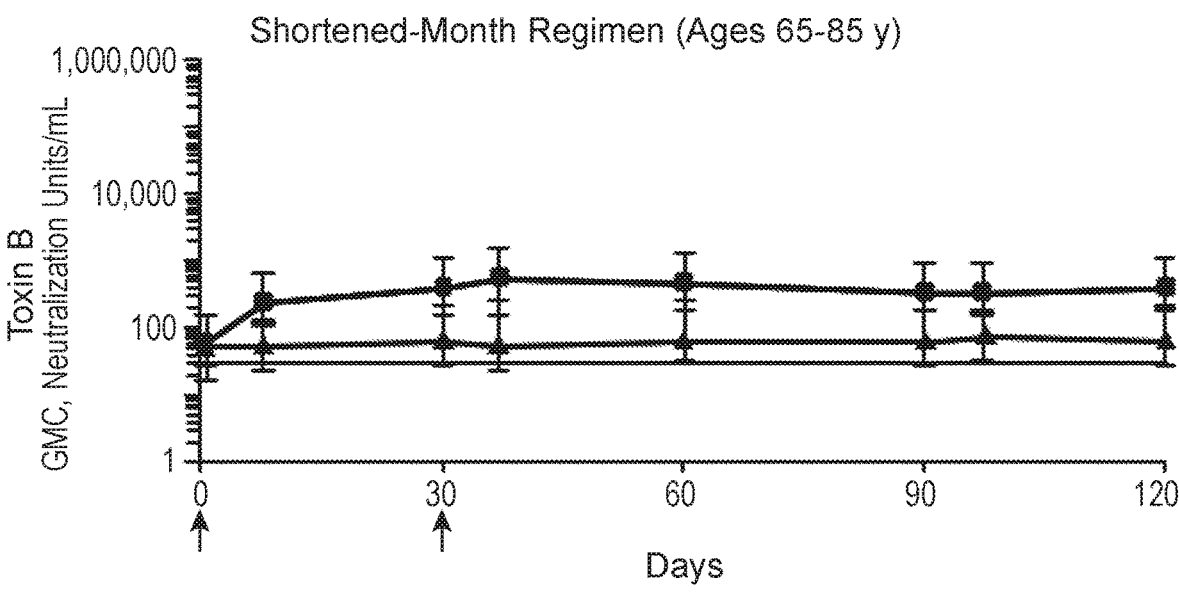
Figures 16C, 16D:
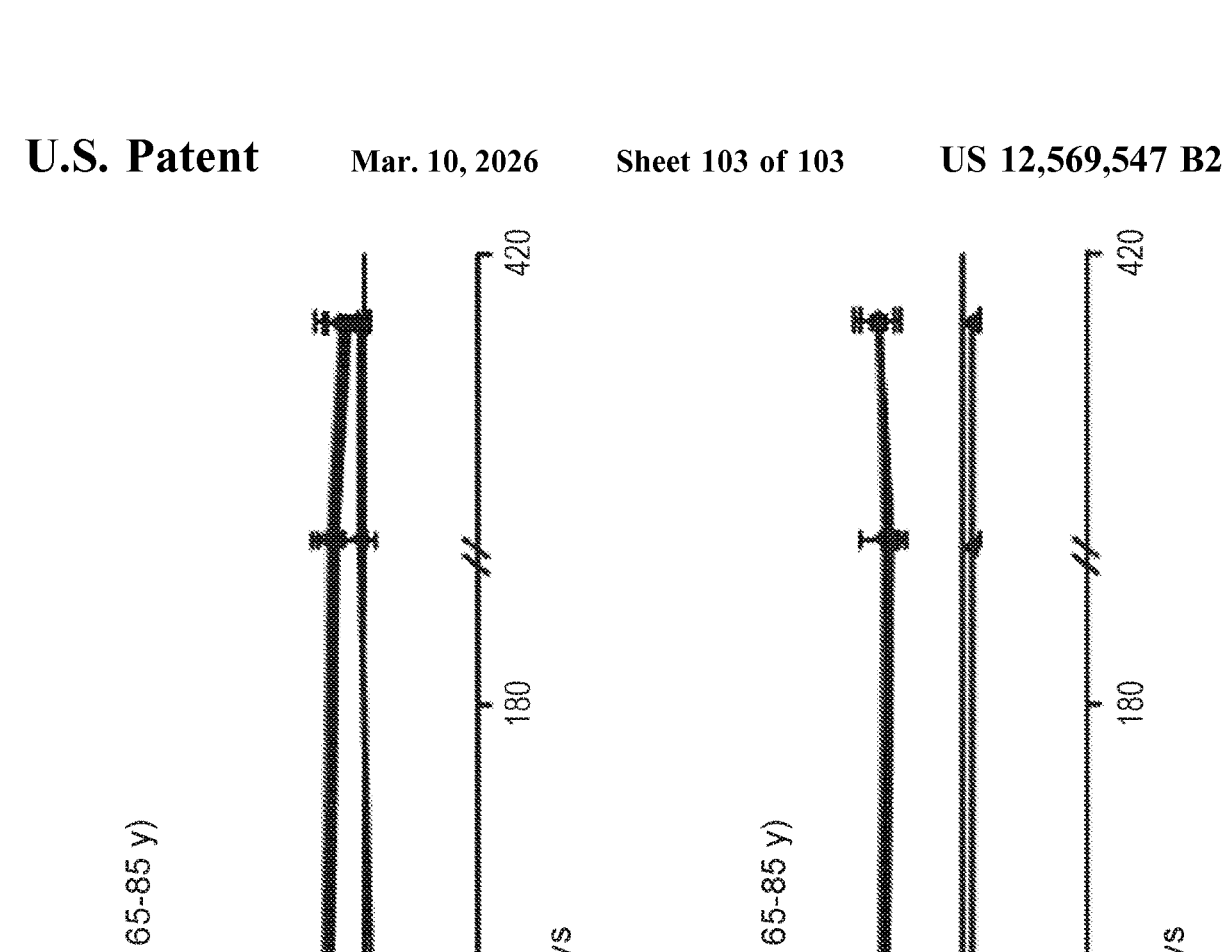

*Clostridioides difficile* is the most commonly recognized cause of infectious diarrhea in healthcare settings. Currently there is no vaccine to prevent *C. difficile* infection (CDI). Two large toxins, TcdA and TcdB, are the primary virulence factors for CDI. Pfizer's investigational *C. difficile* vaccine, which consists of a mixture of genetically and chemically inactivated *C. difficile* toxoids A (TxdA) and B (TxdB), is currently in Phase 3 clinical trials. An understanding of the sequence diversity of the two toxins expressed by disease causing isolates is critical for the interpretation of the polyclonal immune response to the vaccine antigens. In this study, we determined the whole genome sequence (WGS) of 478 *C difficile* isolates collected in 12 countries between 2004-2018 to probe toxin variant amino acid sequence diversity. A total of 44 unique TcdA variants and 37 unique TcdB variants were identified. Each of the TcdA variants shares at least 98% amino acid sequence identity with TcdA001, the variant used to construct the TxdA vaccine antigen. Sequence diversity among the TcdB variants is more substantial, ranging from 86.1% to >99% identity with TcdB001, the TxdB template. Phylogenomic analysis of the WGS data demonstrate that isolates grouped together based on ribotype (RT) or sequence type (ST) can code for multiple different toxin variants. A subset of sequence-diverse toxins was selected to measure the impact of toxin diversity on mammalian cell viability and the ability of polyclonal human immune sera to neutralize cytotoxicity. Serum samples from subjects immunized with the investigational *C. difficile* composition (comprising a polypeptide having the amino acid sequence SEQ ID NO: 4, wherein the methionine is not present (toxoid A), and a second polypeptide having the amino acid sequence SEQ ID NO: 6, wherein the methionine is not present (toxoid B)) were able to neutralize the cytotoxicity of toxins with sequences heterologous to the vaccine antigens, illustrating the broad coverage of the functional immune response to vaccination with these toxoid antigens (FIG. 14).

Example 12

Antibody $K_d$ Values

Binding capability of screened mAbs to toxin A and B was measured by binding ELISA. $EC_{50}$ data showed most of the mAbs exhibited high binding ability to toxin A specifically, except hCDIFA-6 and -41 showed cross activity to toxin B.

TABLE 11

| Antibody | EC50 ($K_d$) |
|---|---|
| hCDIFA-24 | 0.01 |
| hCDIFA-33 | 0.02 |
| hCDIFA-35 | 0.02 |
| hCDIFA-23 | 0.03 |
| hCDIFA-15 | 0.03 |
| hCDIFA-3 | 0.03 |
| hCDIFA-25 | 0.03 |
| hCDIFA-7 | 0.03 |
| hCDIFA-56 | 0.04 |

TABLE 11-continued

| Antibody | EC50 ($K_d$) |
|---|---|
| hCDIFA-58 | 0.04 |
| hCDIFA-29 | 0.04 |
| hCDIFA-31 | 0.04 |
| hCDIFA-5 | 0.04 |
| hCDIFA-38 | 0.04 |
| hCDIFA-34 | 0.04 |
| hCDIFA-8 | 0.04 |
| hCDIFA-59 | 0.05 |
| hCDIFA-29 | 0.05 |
| hCDIFA-36 | 0.05 |
| hCDIFA-49 | 0.05 |
| hCDIFA-11 | 0.05 |
| hCDIFA-37 | 0.05 |
| hCDIFA-32 | 0.05 |
| hCDIFA-1 | 0.05 |
| hCDIFA-46 | 0.05 |
| hCDIFA-50 | 0.06 |
| hCDIFA-55 | 0.06 |
| hCDIFA-30 | 0.06 |
| hCDIFA-12 | 0.06 |
| hCDIFA-41 | 0.06 |
| hCDIFA-26 | 0.06 |
| hCDIFA-43 | 0.07 |
| hCDIFA-30 | 0.08 |
| hCDIFA-6 | 0.09 |
| hCDIFA-14 | 0.1 |
| hCDIFA-42 | 0.1 |
| hCDIFA-27 | 0.1 |
| hCDIFA-39 | 0.11 |
| hCDIFA-2 | 0.11 |
| hCDIFA-17 | 0.11 |
| hCDIFA-9 | 0.12 |
| hCDIFA-16 | 0.13 |
| hCDIFA-47 | 0.14 |
| hCDIFA-4 | 0.15 |
| hCDIFA-13 | 0.15 |
| hCDIFA-28 | 0.28 |
| hCDIFA-51 | 0.28 |
| hCDIFA-40 | 1.76 |
| hCDIFA-48 | 3.17 |
| hCDIFA-53 | 11.29 |
| hCDIFA-54 | 22.93 |
| hCDIFA-18 | 66.18 |
| hCDIFA-20 | 68.91 |
| hCDIFA-21 | 257.5 |
| hCDIFA-22 | 276.1 |
| hCDIFA-10 | — |
| hCDIFA-52 | — |
| hCDIFA-57 | — |

Example 13

Human mAbs Recognize at Least Five Different Epitopes within the GTD Domain

Human PBMC screening has identified 12 monoclonal antibodies that recognize N-terminal (glucosyltransferase (GTD)) domain of the toxoid. The antibodies recognize 5 different epitopes covering most of the solvent accessible surface area of the domain. No antibodies recognizing N-terminal domain were found from the hybridoma fusions performed earlier. Monoclonal antibody hCDIFA-24 is unusual in that it recognizes an epitope that spans spatially adjacent residues in two different structural domains—glucosyltransferase (N-terminal) and autoproteolytic (APD). No antibodies of this kind are known to date.

Monoclonal antibody hCDIFA-35 is the only known antibody that specifically recognizes autoproteolytic domain.

A large number of antibodies that bind in the translocation domain has been identified as well. A number of mAbs share binding epitopes with mouse antibodies isolated from hybridomas.

According to the HDX data, binding of antibodies hCDIFA-6 and hCDIFA-32 increases deuterium uptake in residues that later form translocation pore during cell intoxication and those that form hydrophobic "scaffold" for those helices, preventing premature aggregation of the helices. Increased flexibility observed in the HDX experiments could indicate that the antibodies trigger separation of the helices from the scaffold, which is likely to cause aggregation of the toxoid/toxin due to high hydrophobicity of these structural elements. This premature aggregation will likely prevent cell intoxication, providing a potential toxin neutralization mechanism by those mAbs.

A large number of antibodies recognizing C-terminal (CROP) domain have been discovered. The epitopes are found across the entire domain and may partially overlap in some cases. Since these overlaps are only partial, it is difficult to separate the epitopes into distinct groups/classes.

Several antibodies recognize epitopes that are structurally unstable and are quickly lost during exposure to high pH. These antibodies can be classified as stability indicating.

TABLE 12

| Antibody ID | Epitope | Residues | |
|---|---|---|---|
| hCDIFA-1 | mapping unsuccessful | | Not determined |
| hCDIFA-2 | TLD | 1126-1137, 1173-1191, 1244-1254 | TLD, epitope 1 |
| hCDIFA-3 | GTD | 191-203, 251-260 | GTD, epitope 4 |
| hCDIFA-4 | TLD | 1109-1118, 1190-1207 | TLD, epitope 2 |
| hCDIFA-5 | mapping unsuccessful | | Not determined |
| hCDIFA-6 | TLD | 1173-1189 | TLD, epitope 1 |
| hCDIFA-7 | CROP | 2054-2064 | CROP |
| hCDIFA-8 | CROP | 2698-2710 | CROP |
| hCDIFA-9 | TLD | 1202-1215 | TLD, epitope 2 |
| hCDIFA-10 | mapping unsuccessful | | Not determined |
| hCDIFA-11 | GTD | 409-442 | GTD, epitope 5 |
| hCDIFA-12 | CROP | 2183-2194 | CROP |
| hCDIFA-13 | TLD | 1203-1213 | TLD, epitope 2 |
| hCDIFA-14 | TLD | 1331-1341, 1370-1390 | TLD, epitope 4 |
| hCDIFA-15 | TLD | 1734-1737, 1750-1763, 1779-1798 | TLD, epitope 6 |
| hCDIFA-16 | CROP | 1920-1941, 2054-2075(two copies) | CROP |
| hCDIFA-17 | CROP | 1927-1963, 2195-2235 (at least 2 copies) | CROP |
| hCDIFA-18 | mapping unsuccessful | | Not determined |
| hCDIFA-19 | mapping unsuccessful | | Not determined |
| hCDIFA-20 | mapping unsuccessful | | Not determined |
| hCDIFA-21 | mapping unsuccessful | | Not determined |
| hCDIFA-22 | mapping unsuccessful | | Not determined |
| hCDIFA-23 | CROP | 2693-2710 | CROP |
| hCDIFA-24 | GTD + APD | 412-429, 810-824 | Spans GTD and APD |
| hCDIFA-25 | GTD | 147-157, 210-220 | GTD, epitope 3 |
| hCDIFA-26 | GTD | 114-125, 229-246 | GTD, epitope 2 |
| hCDIFA-27 | GTD | 148-152, 210-222 | GTD, epitope 3 |
| hCDIFA-28 | TLD | 1356-1386 | TLD, epitope 4 |
| hCDIFA-29 | CROP | 1920-1935, 2301-2345, 2348-2362, 2660-2682 (multiple copies) | CROP |
| hCDIFA-30 | CROP | 2097-2117, 2118-2138, 2345-2365, 2366-2385 | CROP |
| hCDIFA-31 | No binding detected by ITC | | Not determined |
| hCDIFA-32 | TLD | 903-920, 1009-1021 | TLD, epitope 5 |
| hCDIFA-33 | GTD | 114-128, 229-246 | GTD, epitope 2 |
| hCDIFA-34 | CROP | 2624-2649 | CROP |
| hCDIFA-35 | APD | 745-777 | The only APD-specific mAb |
| hCDIFA-36 | GTD | 25-51 | GTD, epitope 1 |
| hCDIFA-37 | CROP | 2698-2710 | CROP |
| hCDIFA-38 | GTD | 189-203, 247-258 | GTD, epitope 4 |
| hCDIFA-39 | TLD | 1280-1288, 1330-1337 | TLD, epitope 3 |
| hCDIFA-40 | mapping unsuccessful | | Not determined |
| hCDIFA-41 | mapping unsuccessful | | Not determined |

TABLE 12-continued

| Antibody ID | Epitope | Residues | |
|---|---|---|---|
| hCDIFA-42 | TLD | 1179-1191, 1268-1274 | TLD, epitope 1 |
| hCDIFA-43 | TLD | 889-911, 998-1007 | TLD, epitope 5 |
| hCDIFA-44 | GTD | 189-203, 247-258 | GTD, epitope 4 |
| hCDIFA-45 | GTD | 189-203, 247-258 | GTD, epitope 4 |
| hCDIFA-46 | GTD | 117-126, 227-244 | GTD, epitope 2 |
| hCDIFA-47 | | | Never attempted |
| hCDIFA-48 | TLD | 994-1004, 1374-1390 | TLD, epitope 4 |
| hCDIFA-49 | mapping unsuccessful | | Not determined |
| hCDIFA-50 | CROP | 2372-2389, 2443-2462 | CROP |
| hCDIFA-51 | CROP | ND | CROP |
| hCDIFA-52 | mapping unsuccessful | | Not determined |
| hCDIFA-53 | mapping unsuccessful | | Not determined |
| hCDIFA-54 | TLD | 1178-1189, 1244-1252 | TLD, epitope 1 |
| hCDIFA-55 | CROP | 1927-1964, 2061-2096, 2195-2232 | CROP |
| hCDIFA-56 | mapping unsuccessful | | Not determined |
| hCDIFA-57 | CROP | 2097-2117 | CROP |
| hCDIFA-58 | GTD | 136-144, 212-229, 528-538 | GTD, epitope 3 |
| hCDIFA-59 | CROP | 1920-1939, 2054-2073, 2302-2321 | CROP |

Neutralization capability of human CDIF mAbs; TNA assay using clinical set-up: IMR90, 384w, but 10 dilutions

TABLE 13

| Antibody ID | EC50 TcdA [RLU] | EC50 TcdB [RLU] |
|---|---|---|
| hCDIFA-1 | 5764 | no value |
| hCDIFA-2 | ~38 | no value |
| hCDIFA-3 | 199196 | no value |
| hCDIFA-4 | 22806 | no value |
| hCDIFA-5 | 1448 | no value |
| hCDIFA-6 | 1421 | no value |
| hCDIFA-7 | 13344 | no value |
| hCDIFA-8 | 35390 | no value |
| hCDIFA-9 | na | no value |
| hCDIFA-11 | 60 | no value |
| hCDIFA-12 | ~115 | no value |
| hCDIFA-13 | 26349 | no value |
| hCDIFA-14 | 19777 | no value |
| hCDIFA-15 | ~147 | no value |
| hCDIFA-16 | 298 | no value |
| hCDIFA-17 | no value | no value |
| hCDIFA-18 | 1334 | no value |
| hCDIFA-19 | | no value |
| hCDIFA-20 | 3200 | no value |
| hCDIFA-21 | no value | no value |
| hCDIFA-22 | ~16 | no value |
| hCDIFA-23 | 136 | no value |
| hCDIFA-24 | 6297 | no value |
| hCDIFA-25 | no value | no value |
| hCDIFA-26 | no value | no value |
| hCDIFA-27 | no value | no value |
| hCDIFA-28 | 25838 | no value |
| hCDIFA-29 | no value | no value |
| hCDIFA-30 | 1485 | no value |
| hCDIFA-31 | 530 | no value |

TABLE 13-continued

| Antibody ID | EC50 TcdA [RLU] | EC50 TcdB [RLU] |
|---|---|---|
| hCDIFA-32 | 306 | no value |
| hCDIFA-33 | no value | no value |
| hCDIFA-34 | 247 | no value |
| hCDIFA-35 | ~52 | no value |
| hCDIFA-36 | 426009 | no value |
| hCDIFA-37 | 37140 | no value |
| hCDIFA-38 | 10539 | no value |
| hCDIFA-39 | 400 | no value |
| hCDIFA-40 | no value | no value |
| hCDIFA-41 | 673 | no value |
| hCDIFA-42 | 424 | no value |
| hCDIFA-43 | 3206 | no value |
| hCDIFA-44 | 14753 | no value |
| hCDIFA-45 | 1494 | no value |
| hCDIFA-46 | 1494 | no value |
| hCDIFA-47 | 12672 | no value |
| hCDIFA-48 | no value | no value |
| hCDIFA-49 | 304683 | no value |
| hCDIFA-50 | 1494 | no value |
| hCDIFA-51 | 1635 | no value |
| hCDIFA-52 | 17272 | no value |
| hCDIFA-53 | 4097 | no value |
| hCDIFA-54 | 1494 | no value |
| hCDIFA-55 | 941648 | no value |
| hCDIFA-56 | 111346 | no value |
| hCDIFA-57 | 13352 | no value |
| hCDIFA-58 | no value | no value |
| hCDIFA-59 | 9 | no value |

TABLE 14

| human mABs were characterized by ITC | | | | |
|---|---|---|---|---|
| | Stoichiometry | $K_d$, nM | DH, kcal/mol | Binding epitope |
| hCDIFA11 | 0.97 ± 0.01 | 4 ± 1 | −17.9 ± 0.2 | GTD |
| hCDIFA15 | 1.68 ± 0.04 | 38 ± 16 | −2.7 ± 0.1 | TLD |
| hCDIFA24 | 1.07 ± 0.01 | 6 ± 2 | −11.2 ± 0.2 | GTD + TLD |
| hCDIFA26 | 1.98 ± 0.02 | 8 ± 3 | −9.1 ± 0.2 | GTD |
| hCDIFA32 | 0.21 ± 0.01 | 21 ± 3 | −12 | TLD |
| hCDIFA33 | 0.83 ± 0.02 | 31 ± 16 | −3.0 ± 0.1 | GTD |

TABLE 14-continued

| | Stoichiometry | $K_d$, nM | DH, kcal/mol | Binding epitope |
|---|---|---|---|---|
| | human mABs were characterized by ITC | | | |
| hCDIFA35 | 1.04 ± 0.01 | 8 ± 2 | −16.6 ± 0.2 | APD |
| hCDIFA45 | 0.98 ± 0.03 | 0.3 ± 0.3 | −17.6 ± 0.2 | GTD |
| hCDIFA46 | 1.00 ± 0.02 | 3 ± 1 | −11.3 ± 0.3 | GTD |
| hCDIFA48 | 0.77 ± 0.03 | 87 ± 45 | −7.2 ± 0.5 | TLD |
| hCDIFA56 | 0.78 ± 0.01 | 5 ± 2 | −10.3 ± 0.1 | Not determined |
| hCDIFA29 | 9.2 ± 0.1 | 74 ± 11 | −15.6 ± 0.2 | CROP |
| hCDIFA7 | 2.94 ± 0.04 | 118 ± 20 | −13.5 ± 0.3 | CROP |
| hCDIFA8 | 2.02 ± 0.02 | 20 ± 5 | −6.9 ± 0.2 | CROP |
| hCDIFA1 | 1.45 ± 0.02 | 8 ± 5 | −17.2 ± 0.6 | Not determined |
| hCDIFA37 | 0.95 ± 0.01 | 7 ± 4 | −7.9 ± 0.2 | CROP |

GTD—Glucosyltransferase (catalytic) domain;
APD—Autoprocessing domain;
TLD—Translocation (delivery) domain;
CROP—C-terminal repeats Accordingly, 61 new monoclonal antibodies have been isolated from PBMC's derived from vaccinated subjects. A subset of the antibodies has been characterized in detail. Several of the newly identified human mAbs recognize stability indicating labile epitopes, and may be used as replacement antibodies in IVRA.

---

Sequences relating to monoclonal antibodies

\>hCDIFA-1 Heavy Chain
QLQLQESGPGLVKPSETLSLICTVSGGSFSSSDFYWGWIRQPPGKGLEWIGNFYYNGSTSYNPSLKSR
VTISVDTSKNQFSLKLRSVTAADTAVYYCARDYNFWNNSPNWFDPWGQGTLVTVSSASTKGPSVFPLA
PSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGK (SEQ ID NO: 888)

\>hCDIFA-1 Light Chain
EIVMTQSPATLSVSPGERATLSCRASQSISSNLAWYQQKLGQAPRLLIHGASTRATGIPARFSGSGSG
TQFTLTISSLQSEDFAVYFCQQYNNWPPTFGGGTKVDIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 889)

\>hCDIFA-2 Heavy Chain
QVQLVESGGGLVQPGGSLRLSCAASGFTFSSYAMSWVRQAPGKGPEWVSNIIGSGGSTYFTDSVKGRF
TISRDNSKNTVYLQMNSLRAEDTAVYYCAKEGCRGYDSGNYFAPKMFCLWGQGTLVTVSSASTKGPSV
FPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPV
LDSDGSFFLYSKLTVDKSRWQQGNVFSCSVMHEALHNHYTQKSLSLSPGK (SEQ ID NO: 890)

\>hCDIFA-2 Light Chain
NFMLTQPASVSGSPGQSITISCTGTSSDIGAYNYVSWYQQHPGTAPKLMIYEVSHRPSGVSNRFSGSK
SGDTASLTISGLQAEDEADYYCSSYTTSITYVFGTGTKLTVLGQPKAAPSVTLFPPSSEELQANKATL
VCLISDFYPGAVTVAWKADSSPVKAGVETTTPSKQSNNKYAASSYLSLTPEQWKSHRSYSCQVTHEGS
TVEKTVAPTECS (SEQ ID NO: 891)

\>hCDIFA-3 Heavy Chain
EVQLVESGGGVVQPGRSLRLSCAASGFTFSSYAMHWVRQAPGKGLEWVAVISKDGDNKYYTDPLKGRF
TISRDNSKNTLYLQMISLRGEDTAVYYCARDLNIWSGYYLRTINYMDVWGKGTTVTVSSASTKGPSV
FPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPV
LDSDGSFFLYSKLTVDKSRWQQGNVFSCSVMHEALHNHYTQKSLSLSPGK (SEQ ID NO: 892)

\>hCDIFA-3 Light Chain
DIVMTQSPSFLSASVGDRVTITCRASQGIRNDLGWYQQKPGKAPKLLIYAASTLQSGVPSRFSGSGSG
TEFTLTISSLQPEDFATYYCOOPGSHPPFGGGAKLEIKRTVAAPSVFIFPPSDEQLKSGTASVVCLLN
NFYPREAKVQWKVDNALQSGNSQESVTEQDSKDSTYSLSSTLTLSKADYEKHKVYACEVTHQGLSSPV
TKSFNRGEC (SEQ ID NO: 893)

\>hCDIFA-4 Heavy Chain
QVQLQESGPGLVKPSGTLSLTCAVSGGSISSINWWSWVRQPPGKGLEWIGEIYHSGSTNYNPSLKSRV
TISVDKSKNQFSLKLSSVTAADTAVYYCAREGKVDSSSQGNWFDPWGQGTLVTVSSASTKGPSVFPLA -continued

| Sequences relating to monoclonal antibodies |
| --- |

PSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGK (SEQ ID NO: 894)

>hCDIFA-4 Light Chain
QPVLTQPRSVSGSPGQSVTISCTGTSSDVGGYNYVSWYQQHPGKAPKFMIYDVSKRPSGVPDRFSGSK
SGNTASLTISGLQAEDEADYYCCSYAGTYTFYVFGTGTKVTVLGQPKAAPSVTLFPPSSEELQANKAT
LVCLISDFYPGAVTVAWKADSSPVKAGVETTTPSKQSNNKYAASSYLSLTPEQWKSHRSYSCQVTHEG
STVEKTVAPTECS (SEQ ID NO: 895)

>hCDIFA-5 Heavy Chain
EVQLVESGPGLVKPSETLSLTCAVSGGSISGYYWSWIRQPPGKGLEWIAYIYDSGSTSHNPSLKSRVT
TSVDTSKNQFSLKLNSVTAADTAVYYCARSGKWALGAFDMWGQGTMVTVSSASTKGPSVFPLAPSSKS
TSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHED
PEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFL
YSKLTVDKSRWQQGNVFSCSVMHEALHNHYTQKSLSLSPGK (SEQ ID NO: 896)

>hCDIFA-5 Light Chain
QSALTQPPSVSGAPGQRVTISCTGSSSNIGAGYDVHWYQQLPGTAPKLLISGNNNRPSGVPDRFSGSK
SGTSASLAITGLQAEDEADYYCQSYDNDLSGLVVFGGGTKLTVLGQPKAAPSVTLFPPSSEELQANKA
TLVCLISDFYPGAVTVAWKADSSPVKAGVETTTPSKQSNNKYAASSYLSLTPEQWKSHRSYSCQVTHE
GSTVEKTVAPTECS (SEQ ID NO: 897)

>hCDIFA-6 Heavy Chain
QVQLQESGPGLVKPSQTLSLTCSVSGDSSSSGDYYWNWIRQPAGKGLEWIGYIYTSGSTNYNPSLKSR
VTISEDTSKKQFSLKLTSVTAADTAVYYCARGIVGVGLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHED
PEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFL
YSKLTVDKSRWQQGNVFSCSVMHEALHNHYTQKSLSLSPGK (SEQ ID NO: 898)

>hCDIFA-6 Light Chain
EIVMTQSPSTLSASVGDRVTITCRASQTISSWLAWYQQKPGRAPKLLMSKTSTLQPGVPSRFSGSGSG
TEFTLTISGLQPDDVATYYCHHYNSWPFGPGTKVEIKRTVAAPSVFIFPPSDEQLKSGTASVVCLLNN
FYPREAKVQWKVDNALQSGNSQESVTEQDSKDSTYSLSSTLTLSKADYEKHKVYACEVTHQGLSSPVT
KSFNRGEC (SEQ ID NO: 899)

>hCDIFA-7 Heavy Chain
QVQLRESGPGLVKPSETLSLTCTVSGGSVSNYYWSWIRQPPGKGLEWIGYIYSSGTINFNPSLKGRVT
ISGDTSKNQFSLKLSSVTAADTAVYYCARSGKWALGAFDIWGQGTMVTVSSASTKGPSVFPLAPSSKS
TSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHED
PEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFL
YSKLTVDKSRWQQGNVFSCSVMHEALHNHYTQKSLSLSPGK (SEQ ID NO: 900)

>hCDIFA-7 Light Chain
QSALTQPPSVSGAPGQRVTISCTGSSSNIGTGYDVHWYQQLPGKVPKLLIHGNGDRPSGVPDRFSASK
SGTSASLAITGLQSEDEGDYYCQSYDNSLSGLVVFGGGTKLTVLGQPKAAPSVTLFPPSSEELQANKA
TLVCLISDFYPGAVTVAWKADSSPVKAGVETTTPSKQSNNKYAASSYLSLTPEQWKSHRSYSCQVTHE
GSTVEKTVAPTECS (SEQ ID NO: 901)

>hCDIFA-8 Heavy Chain
QVQLVESGGGLVKPGGSLRLSCAASGFTFSTSSMNWVRQAPGKGLEWVSSINTSGDYIYYTDSVKGRF
TISRDNAKNSLYLQMNSLRAEDTAVYYCARDLGTWRDYWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK (SEQ ID NO: 902)

>hCDIFA-8 Light Chain
QSVLTQPASVSGSPGQSITISCTGTSSDVGSYNLVSWYHQHPGKAPKLIIYEVSKRPSGVSNRFSGSK
SGNTASLTISGLQAEDEADYYCYSYAGSSAFAWVFGTGTKLTVLGQPKAAPSVTLFPPSSEELQANKA
TLVCLISDFYPGAVTVAWKADSSPVKAGVETTTPSKQSNNKYAASSYLSLTPEQWKSHRSYSCQVTHE
GSTVEKTVAPTECS
(SEQ ID NO: 903)

>hCDIFA-9 Heavy Chain
QVQLVQSGAEVKKPGASVKLSCQASGYTFPSYYVHWVRQAPGQGLEWMGIINPNGGVTSYAKKFQGRI
TVTGDTCCTTVHMELNSLTSEDTAVYYCVRVLTVADPPWALDFWGQGTLVTVSSASTKGPSVFPLAPS
SKSTSGGTAALGCLVKDYFPEPVTVSWNSGALTSGVHTFPAVLQSSGLYSLSSVVTVPSSSLGTQTYI <div style="text-align: center;">Sequences relating to monoclonal antibodies</div>

CNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIEKT
ISKAKGQPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK (SEQ ID NO: 904)

>hCDIFA-9 Light Chain
QAVVTQPASVSGSPGQSITISCTGTSSDVGNYYLVSWYQQHPGKVPKLMIYEVNKRPSGVSDRFSGSK
SGSTASLTISGLQAEDEADYYCSSYGGRSTLLFGGGTKVTVLGQPKAAPSVTLFPPSSEELQANKATL
VCLISDFYPGAVTVAWKADSSPVKAGVETTTPSKQSNNKYAASSYLSLTPEQWKSHRSYSCQVTHEGS
TVEKTVAPTECS (SEQ ID NO: 905)

>hCDIFA-10 Heavy Chain
QLQLQESGPGLVKPSETLSLTCTVSGGSISSYYWSWIRQPAGKGLEWIGRIYTSGSTNYNPSLKSRVT
ISVDKSKNQFSLKLSSVTAADTAVYYCARDHPTYYDFWSGKYYYYYYGMDVWGQGTTVTVSSASTKGP
SVFPLAPSSKSTSGGTAALGCLVKDYFPEPVTVSWNSGALTSGVHTFPAVLQSSGLYSLSSVVTVPSS
SLGTQTYICNVNHKPSNTKVDKKVEPKSCDKTHTCPPCPAPELLGGPSVFLFPPKPKDTLMISRTPEV
TCVVVDVSHEDPEVKFNWYVDGVEVHNAKTKPREEQYNSTYRVVSVLTVLHQDWLNGKEYKCKVSNKA
LPAPIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK (SEQ ID NO:
906)

>hCDIFA-10 Light Chain
QSVLTQPPSVSVSPGQTARITCSGDALPKQYAYWYQQKPGQAPVLVIYKDSERPSGIPERFSGSSSGT
TVTLTISGVQAEDEADYYCQSADSSGTWVFGGGTKLTVLGQPKAAPSVTLFPPSSEELQANKATLVCL
ISDFYPGAVTVAWKADSSPVKAGVETTTPSKQSNNKYAASSYLSLTPEQWKSHRSYSCQVTHEGSTVE
KTVAPTECS (SEQ ID NO: 907)

>hCDIFA-11 Heavy Chain
QVQLVQSATEMKKPGASVKVSCKASGYTFSDSYMHWVRQAPGQGLEWMGWINPDSGGTNYAQKFKGWV
TMTRDTSINTVYMELRRLRSDDTAVYYCARDGGDYARHSLDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK (SEQ ID NO: 908)

>hCDIFA-11 Light Chain
DVVMTQSPGTLSLSPGERVTLSCRASQSVNSDYLVWYQQKPGQAPRLLIYGASSRATGIPDRFSGSGS
GPDFTLTISRLEPEDVAVYYCQLYGGLFTFGQGTRLEIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 909)

>hCDIFA-12 Heavy Chain
QVQLVQSGAEVKKPGASVKVSCKASGYTFSDSYMHWVRQAPGQGLEWMGRINPNSGGTNYAQKFQGRV
TMTRDTSIKTVYMELSRLRSDDGAIYYCARGMGRTTTGLFDLWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK (SEQ ID NO: 910)

>hCDIFA-12 Light Chain
DIVMTQSPATLSLSPGERATLSCKANESVGSYLVWYQQKFGQAPRLLIYDASNRATGIPARFSGSGSG
TDFTLTISSLEPEDFAVYYCQQRSNWPPTFGGGTKVDIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 911)

>hCDIFA-13 Heavy Chain
QVQLVQSGAEVKKPGASVTVSCRTSGYTFTNDYVHWVRQAPGQGLEWVGLINPSGGNTVYAQSFQGRV
TMTRDTSTSTVYMELSSLRSEDTAVYYCARVVHDYGKFDPWGQGTPVTVSSASTKGPSVFPLAPSSKS
TSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHED
PEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFL
YSKLTVDKSRWQQGNVFSCSVMHEALHNHYTQKSLSLSPGK (SEQ ID NO: 912)

>hCDIFA-13 Light Chain
SYELTQPASVSGSPRQSITISCTGTSSDVGNYNLVSWYQQYPGKAPRLIIFEVRQRPSGVSNRFSGSK
SGNTASLTISGLQAADEADYYCCSYAGRSIWVFGGGTKLTVLGQPKAAPSVTLFPPSSEELQANKATL
VCLISDFYPGAVTVAWKADSSPVKAGVETTTPSKQSNNKYAASSYLSLTPEQWKSHRSYSCQVTHEGS
TVEKTVAPTECS (SEQ ID NO: 913)

>hCDIFA-14 Heavy Chain
EVQLVQSGAEVKKPGSSVKVSCKASGGTFRSYAISWVRQAPGQGLEWMGGFIPIPGIRNYAQKFQGRL
TISADESTSTGYMELSSLTSEDTAVYYCARGLGRVSHYFYYMDVWGKGTTVTVSSASTKGPSVFPLAP
SSKSTSGGTAALGCLVKDYFPEPVTVSWNSGALTSGVHTFPAVLQSSGLYSLSSVVTVPSSSLGTQTY
ICNVNHKPSNTKVDKKVEPKSCDKTHTCPPCPAPELLGGPSVFLFPPKPKDTLMISRTPEVTCVVVDV -continued

| Sequences relating to monoclonal antibodies |
| --- |

SHEDPEVKFNWYVDGVEVHNAKTKPREEQYNSTYRVVSVLTVLHQDWLNGKEYKCKVSNKALPAPIEK
TISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK (SEQ ID NO: 914)

>hCDIFA-14 Light Chain
EIVMTQSPDSLAVSLGERATINCKSSQTVLYSSNNKNYLAWYQQKPGQPPKLLIYWASTRESGVPDRF
SGSGSGTDFTLTISNLQAEDVAIYYCQQYYSTPPTFGQGTKVEIKRTVAAPSVFIFPPSDEQLKSGTA
SVVCLLNNFYPREAKVQWKVDNALQSGNSQESVTEQDSKDSTYSLSSTLTLSKADYEKHKVYACEVTH
QGLSSPVTKSFNRGEC (SEQ ID NO: 915)

>hCDIFA-15 Heavy Chain
QVQLVQSGAEVKKPGASVKISCKASGYTFVRYYMHWVRQAPGQGLEWMGLIDPSGGSTRYAQRFQGRV
TMTRDTSTSTVYMELSGLRSEDTAVYYCARDGPFGGLSGGNWFDPWGQGTLVTVSSASTKGPSVFPLA
PSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGK (SEQ ID NO: 916)

>hCDIFA-15 Light Chain
AIRMTQSPGTLSLSPGERATLSCRASQSLSFSYLAWYQQKPGQAPRLLIYGASSRATGIPDRFSGSGS
GTDFALTISRLEPEDFAVYYCQQYGTSPLTFGGGTKVDIKRTVAAPSVFIFPPSDEQLKSGTASVVCL
LNNFYPREAKVQWKVDNALQSGNSQESVTEQDSKDSTYSLSSTLTLSKADYEKHKVYACEVTHQGLSS
PVTKSFNRGEC (SEQ ID NO: 917)

>hCDIFA-16 Heavy Chain
QVQLQESGPGLVKPSETLSLTCTVSGDSISDYYWSWIRQPPGRGLEWIGYIYYSGSTNYNPSLKSRLT
ISVDTSKNQFSLNLSSVTAADTAVYYCARSMGHYDFWNTYFPCFDPWGQGTLVTVSSASTKGPSVFPL
APSSKSTSGGTAALGCLVKDYFPEPVTVSWNSGALTSGVHTFPAVLQSSGLYSLSSVVTVPSSSLGTQ
TYICNVNHKPSNTKVDKKVEPKSCDKTHTCPPCPAPELLGGPSVFLFPPKPKDTLMISRTPEVTCVVV
DVSHEDPEVKFNWYVDGVEVHNAKTKPREEQYNSTYRVVSVLTVLHQDWLNGKEYKCKVSNKALPAPI
EKTISKAKGQPREPQVYTLPPSREEMTKNQVSLTCLVKGFYPSDIAVEWESNGQPENNYKTTPPVLDS
DGSFFLYSKLTVDKSRWQQGNVFSCSVMHEALHNHYTQKSLSLSPGK (SEQ ID NO: 918)

>hCDIFA-16 Light Chain
EIVMTQSPGTLSLSPGERATLSCRASQSVSSGYLAWYQQKPGQAPRLLIYGASSRATGIPDRFRGSGS
GTDFTLTISRLEPEDFAVYYCQQYGSSPLTFGGGTKLEIKRTVAAPSVFIFPPSDEQLKSGTASVVCL
LNNFYPREAKVQWKVDNALQSGNSQESVTEQDSKDSTYSLSSTLTLSKADYEKHKVYACEVTHQGLSS
PVTKSFNRGEC (SEQ ID NO: 919)

>hCDIFA-17 Heavy Chain
EVQLVESGGGLVQPGGSLRLSCAASGFTFSSYEMTWVRQAPGRGLELVSHISGSTIYYADSVKGRFTI
SRDNAKNSLYLQMNSLRAEDTAIYYCARDGDSGTVVTFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHED
PEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFL
YSKLTVDKSRWQQGNVFSCSVMHEALHNHYTQKSLSLSPGK (SEQ ID NO: 920)

>hCDIFA-17 Light Chain
AIRMTQSPSSLSASVGDRVTITCRASQSISNYLNWYQQKPGKAPNLLIYGTSSLQSGVPSRFSGSGSG
TDFTLTINSLQPEDFATYYCQQSYSSPCTFGRGTKVDIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 921)

>hCDIFA-18 Heavy Chain
QVQLVQSGAEVKKPGASVKVSCKASGYTFTSYAMHWVRQAPGQRLEWMGWINAGNGNTKYSQEFQGRV
TITRDTSASTAYMELSSLRSEDMAVYYCARAHLPGYCSSTSCYIMYVWGKGTTVTVSSASTKGPSVFP
LAPSSKSTSGGTAALGCLVKDYFPEPVTVSWNSGALTSGVHTFPAVLQSSGLYSLSSVVTVPSSSLGT
QTYICNVNHKPSNTKVDKKVEPKSCDKTHTCPPCPAPELLGGPSVFLFPPKPKDTLMISRTPEVTCVV
VDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLD
SDGSFFLYSKLTVDKSRWQQGNVFSCSVMHEALHNHYTQKSLSLSPGK (SEQ ID NO: 922)

>hCDIFA-18 Light Chain
EIVMTQSPDSLAVSLGERATINCKSSQSVLYSSNNKNYLAWYQQKPGQPPKLLIYWASTRESGVPDRF
SGSGSGTDFTLTISSLQAEDVAVYYCQQYYSTPWTFGQGTKVDIKRTVAAPSVFIFPPSDEQLKSGTA
SVVCLLNNFYPREAKVQWKVDNALQSGNSQESVTEQDSKDSTYSLSSTLTLSKADYEKHKVYACEVTH
QGLSSPVTKSFNRGEC (SEQ ID NO: 923)

>hCDIFA-19 Heavy Chain
QVQLVESGPGLVKPSETLSLTCTVSGGSISSSSYYWGWIRQPPGKGLEWIGSIYYSGSTYYNPSLKSR
VTISVDTSKNQFSLKLSSVTAADTAVYYCASGPPFYVGWHKYYYYYYMDVWGKGTTVTVSSASTKGP
SVFPLAPSSKSTSGGTAALGCLVKDYFPEPVTVSWNSGALTSGVHTFPAVLQSSGLYSLSSVVTVPSS
SLGTQTYICNVNHKPSNTKVDKKVEPKSCDKTHTCPPCPAPELLGGPSVFLFPPKPKDTLMISRTPEV -continued

---

Sequences relating to monoclonal antibodies

---

TCVVVDVSHEDPEVKFNWYVDGVEVHNAKTKPREEQYNSTYRVVSVLTVLHQDWLNGKEYKCKVSNKA
LPAPIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK (SEQ ID NO:
924)

>hCDIFA-19 Light Chain
DVVMTQSPDSLAVSLGERATINCKSSQSVLYSSNNKNYLAWYQQKPGQPPKLLIYWASTRESGVPDRF
SGSGSGTDFTLTISSLQAEDVAVYYCQQYYSTPVTFGQGTKVDIKRTVAAPSVFIFPPSDEQLKSGTA
SVVCLLNNFYPREAKVQWKVDNALQSGNSQESVTEQDSKDSTYSLSSTLTLSKADYEKHKVYACEVTH
QGLSSPVTKSFNRGEC (SEQ ID NO: 925)

>hCDIFA-20 Heavy Chain
EVQLVQSGAEVRIPGASVKVSCKASGFTFNDYYIHWVRQAPGQGLEWMGWINAHNGVTSYAQNFQDRV
TMTRDTSITTAYMDLSRLRSDDTAVYYCARDCSTSSCFDHWGQGSLVTVSSASTKGPSVFPLAPSSKS
TSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHED
PEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFL
YSKLTVDKSRWQQGNVFSCSVMHEALHNHYTQKSLSLSPGK (SEQ ID NO: 926)

>hCDIFA-20 Light Chain
SYELTQPPSLSVAPGKTAKITCGGNNIGSKGVHWYQQRPGQAPVLVIYYNADRPSGIPERFSGSNSGN
TATLTISRVEAGDEADYFCQVWDGDSAHRVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS (SEQ ID NO: 927)

>hCDIFA-21 Heavy Chain
QVQLQQSGPGLVKPSQTLSLTCTVSGGSISSGGYYWSWIRQHPGKGLEWIGYIYYSGSTYYNPSLKSR
VTISVDTSKNQFSLKLSSVTAADTAVYYCARALRGVSIAARLAHFNWFDPWGQGTLVTVSSASTKGPS
VFPLAPSSKSTSGGTAALGCLVKDYFPEPVTVSWNSGALTSGVHTFPAVLQSSGLYSLSSVVTVPSSS
LGTQTYICNVNHKPSNTKVDKKVEPKSCDKTHTCPPCPAPELLGGPSVFLFPPKPKDTLMISRTPEVT
CVVVDVSHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPP
VLDSDGSFFLYSKLTVDKSRWQQGNVFSCSVMHEALHNHYTQKSLSLSPGK (SEQ ID NO: 928)

>hCDIFA-21 Light Chain: 929
NFMLTQPPSVSVSPGQTASITCSGDKLGDKYACWYQQKPGQSPVLVIYQDSKRPSGIPERFSGSNSGN
TATLTISGTQAMDEADYYCQAWDSSTAVVFGGGTKLTALGQPKAAPSVTLFPPSSEELQANKATLVCL
ISDFYPGAVTVAWKADSSPVKAGVETTTPSKQSNNKYAASSYLSLTPEQWKSHRSYSCQVTHEGSTVE
KTVAPTECS (SEQ ID NO: 929)

>hCDIFA-22 Heavy Chain
QVQLVQSGGGLVQPGGSLRLSCSASGFTFSSYAMHWVRQAPGKGLEYVSAISSNGGSTYYADSVKGRF
TISRDNSKNTLYLQMSSLRAEDTAVYYCVRAAAGNWFDPWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGK (SEQ ID NO: 930)

>hCDIFA-22 Light Chain
AIRMTQSPSSVSASVGDRVTITCRASQGISSWLAWYQQKPGKAPKLLIYAASSLQSGVPSRFSGSGSG
TDFTLTISSLQPEDFATYYCQQANSFPLTFGGGTKVDIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 931)

>hCDIFA-23 Heavy Chain
QVQLVQSGGGVVQPGRSLRLSCAASGFTFSQYSIHWVRQAPGKGLEWVAVMSYDGRNKYYADSVKGRF
TISGDNSRNTLYVQMNSLRAEDTAIYYCARDLIKAAMVPAFDIWGQGTMVTVSSASTKGPSVFPLAPS
SKSTSGGTAALGCLVKDYFPEPVTVSWNSGALTSGVHTFPAVLQSSGLYSLSSVVTVPSSSLGTQTYI
CNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIEKT
ISKAKGQPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK (SEQ ID NO: 932)

>hCDIFA-23 Light Chain
TALTQPRSVSGSPGQSVTISCTGTNSDVADYNYVSWYQHHPGKAPKLMIYDVTKRPSGVPDRFSGSKS
GNTASLTISGLQAEDEADYYCCSYAARYTFGGGTKLTVLGQPKAAPSVTLFPPSSEELQANKATLVCL
ISDFYPGAVTVAWKADSSPVKAGVETTTPSKQSNNKYAASSYLSLTPEQWKSHRSYSCQVTHEGSTVE
KTVAPTECS (SEQ ID NO: 933)

>hCDIFA-24 Heavy Chain
QVQLVQSGGGVVQPGRSLRLSCAASGFSFSTHGMHWVRQAPGKGLEWVAVISYDGSNKYYADSVKGRF
TISRDNSKNTVYLQMNSLRAEDTAVFYCAKPRDNYYYGMDVWGQGTTVTVSSASTKGPSVFPLAPSS
KSTSGGTAALGCLVKDYFPEPVTVSWNSGALTSGVHTFPAVLQSSGLYSLSSVVTVPSSSLGTQTYIC -continued

| Sequences relating to monoclonal antibodies |
| --- |

NVNHKPSNTKVDKKVEPKSCDKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK (SEQ ID NO: 934)

>hCDIFA-24 Light Chain
AIRMTQSPSSLSASTGNRVTITCRASQGISSYLAWYQQKPGKAPNLLIYAASTLQSGVPSRFTGSGSG
TDFTLTISRLHSENFATYYCQQYFNYPRTFGQGTRLEIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 935)

>hCDIFA-25 Heavy Chain
QVQLVESGPGLVKPSETLFLTCNVSGFSILSSTYYWAWMRQSPGKGLEWIGGIYYTGSTYYTPSLRSR
ITISLDTSKNQISLNLASVTAADTALYYCARRRHGVVDLYFDVWGRGTLVTVSSASTKGPSVFPLAPS
SKSTSGGTAALGCLVKDYFPEPVTVSWNSGALTSGVHTFPAVLQSSGLYSLSSVVTVPSSSLGTQTYI
CNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIEKT
ISKAKGQPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK (SEQ ID NO: 936)

>hCDIFA-25 Light Chain
DIVMTQSPATLSVSPGERATLSCRASQSVGKNLAWYQQKPGEGPSLLIYGAFSRATGIPARFTGSGSG
TNFTLTISSLQSEDFAVYYCQQYDHWLTFGGGTKLEIKRTVAAPSVFIFPPSDEQLKSGTASVVCLLN
NFYPREAKVQWKVDNALQSGNSQESVTEQDSKDSTYSLSSTLTLSKADYEKHKVYACEVTHQGLSSPV
TKSFNRGEC (SEQ ID NO: 937)

>hCDIFA-26 Heavy Chain
EVQLLESGAEVKKPGESLRISCNCSGYSFTSYWIGWVRQMPGEGLEWMGLIQPGGDSYPRYSPSFQGQ
VTISADKSISTAYLQWRSLKASDTAMYYCARRGFDHWGQGTLVTVSSASTKGPSVFPLAPSSKSTSGG
TAALGCLVKDYFPEPVTVSWNSGALTSGVHTFPAVLQSSGLYSLSSVVTVPSSSLGTQTYICNVNHKP
SNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK (SEQ ID NO: 938)

>hCDIFA-26 Light Chain
NFMLTQPPSASGAPGQRVTISCSGSSSNIGSNTVNWYQQLPGTAPKLLIYSNIQRPSGVPDRFSGSKS
GTSASLAISGLQSDDEADYYCSAWDDSLNGYVFGTGTKVTLGQPKAAPSVTLFPPSSEELQANKATL
VCLISDFYPGAVTVAWKADSSPVKAGVETTTPSKQSNNKYAASSYLSLTPEQWKSHRSYSCQVTHEGS
TVEKTVAPTECS (SEQ ID NO: 939)

>hCDIFA-27 Heavy Chain
EVQLVETGPGLVKPSETLSLTCTVSGGSISSSSYYWGWIRQPPGKGLEWIGSMSYFGSTHYNPSLKSR
VTISVDTSKNQFSLKLSSVTAADTAVYYCARHKVIKNYYNNYVLGYFDYWGQGMLVTVSSASTKGPSV
FPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPV
LDSDGSFFLYSKLTVDKSRWQQGNVFSCSVMHEALHNHYTQKSLSLSPGK (SEQ ID NO: 940)

>hCDIFA-27 Light Chain
EIVLTQSPGTLSLSPGERATLSCRASQSVSSSYLAWYQQKPGRAPRLLIYGASSRATGIPDRFSGSGS
GTDFTLTISRLEPEDFAVYYCQQYGSAPPWTFGQGTKVEIKRTVAAPSVFIFPPSDEQLKSGTASVVC
LLNNFYPREAKVQWKVDNALQSGNSQESVTEQDSKDSTYSLSSTLTLSKADYEKHKVYACEVTHQGLS
SPVTKSFNRGEC (SEQ ID NO: 941)

>hCDIFA-28 Heavy Chain
QVQLVQSGAQVKKPGSSVKVSCKASGYAFISYGITWVRQAPGQGLEWMGWISAYNGDTNYAQKFQGRV
TMTTDTSTNTAYMELRSLRSDDTAVYYCARALTRVAVALPHPYWGQGTLVTVSSASTKGPSVFPLAPS
SKSTSGGTAALGCLVKDYFPEPVTVSWNSGALTSGVHTFPAVLQSSGLYSLSSVVTVPSSSLGTQTYI
CNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIEKT
ISKAKGQPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK (SEQ ID NO: 942)

>hCDIFA-28 Light Chain
EIVLTQSPDSLAVSLGERATINCKSSQSVLYSSNNKNYLTWYQQKPGQPPKLLIYWASTRESGVPDRF
SGSGSGTDFTLTISSLQAEDVAVYYCQQYYSTPWTFGQGTKLEIKRTVAAPSVFIFPPSDEQLKSGTA
SVVCLLNNFYPREAKVQWKVDNALQSGNSQESVTEQDSKDSTYSLSSTLTLSKADYEKHKVYACEVTH
QGLSSPVTKSFNRGEC (SEQ ID NO: 943)

>hCDIFA-29 Heavy Chain
EVQLLESGAEVKKPGASIRVSCKASGHSFTDSFTDYYFHWVRQAPGQGLEWMGMINPSVGSTNYAQKF
QGRVTLTRDTSTHTVYMELSSLRSEDTAVYFCARDPWFCSRGTSCYYFGLWGQGTLVTVSSASTKGPS
VFPLAPSSKSTSGGTAALGCLVKDYFPEPVTVSWNSGALTSGVHTFPAVLQSSGLYSLSSVVTVPSSS
LGTQTYICNVNHKPSNTKVDKKVEPKSCDKTHTCPPCPAPELLGGPSVFLFPPKPKDTLMISRTPEVT Sequences relating to monoclonal antibodies CVVVDVSHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPP
VLDSDGSFFLYSKLTVDKSRWQQGNVFSCSVMHEALHNHYTQKSLSLSPGK (SEQ ID NO: 944)

>hCDIFA-29 Light Chain
DIQLTQSPSSLSASVGDSVTITCRASQSISTYLNWYQQKPGKAPKLLIYDASSLLSGVPSRFSGGGSG
TDFTLTISSLQPEDFATYYCQQSDISPPVFGRGTKVEIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 945)

>hCDIFA-30 Heavy Chain
EVQLVESGAEVKRPGASVKVSCRTSAYAFTNYFMHWVRQAPGQGLEWVAVINLSGGNTNYAQSFQGRV
NMTRDTSTSTVYMELSSLRSEDTAVYFCAIGGIWFGEYPNWFDPWGQGTLVTVSSASTKGPSVFPLAP
SSKSTSGGTAALGCLVKDYFPEPVTVSWNSGALTSGVHTFPAVLQSSGLYSLSSVVTVPSSSLGTQTY
ICNVNHKPSNTKVDKKVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALPAPIEK
TISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK (SEQ ID NO: 946)

>hCDIFA-30 Light Chain
NFMLTQPPSVSAAPGRKVTVSCSGSSSNIGNNYVSWYQQFPGTAPKLLIYDNNKRHSGIPARFSGSKS
GTSATLGITGLQTGDEADYYCATWDSSLKYWFGGGTKLTVLGQPKZXAPSVTLFPPSSEELQANKATL
VCLISDFYPGAVTVAWKADSSPVKAGVETTTPSKQSNNKYAASSYLSLTPEQWKSHRSYSCQVTHEGS
TVEKTVAPTECS (SEQ ID NO: 947)

>hCDIFA-31 Heavy Chain
QVQLVQSGPRLVKPSGTLSLTCAVSGASITSSNWWSWVRQPPGEGLEWIGEIHHSGGITYNPSLMGRV
TISLDKSKNSFSLVVTSVTAADTAFYFCARSGRGQLGLPDLWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICN
VNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTIS
KAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 948)

>hCDIFA-31 Light Chain
DVVMTQSPDSLAVSLGERATINCKSSQSVLYSSNNKNYLAWYQQKPGQPPKLLIYWASTRESGVPDRF
SGSGSGTDFTLTISSLQAEDVAVYYCQQYYSTPPFFGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYACEVTH
QGLSSPVTKSFNRGEC (SEQ ID NO: 949)

>hCDIFA-32 Heavy Chain
QVQLQESGPGLVKPSETLSLTCTVSGGSISSHYWSWIRQTPGKGLEYIGNIYYTGRTKYNPSLKSRVT
ISADMSKNQVSLKLNSVTAADTAVYYCARGGPLMDVWGQGTTVTVSSASTKGPSVFPLAPSSKSTSGG
TAALGCLVKDYFPEPVTVSWNSGALTSGVHTFPAVLQSSGLYSLSSVVTVPSSSLGTQTYICNVNHKP
SNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK (SEQ ID NO: 950)

>hCDIFA-32 Light Chain
DIVMTQSPATLSVSPGERATLSCRASQSISSNLAWYQQKPGQAPRLLIYGASTRATGIPARFSGSGSG
TEFTLTISSLQSEDFAIYYCQQYSNWPLWTFGQGTKLEIKRTVAAPSVFIFPPSDEQLKSGTASVVCL
LNNFYPREAKVQWKVDNALQSGNSQESVTEQDSKDSTYSLSSTLTLSKADYEKHKVYACEVTHQGLSS
PVTKSFNRGEC (SEQ ID NO: 951)

>hCDIFA-33 Heavy Chain
QVQLVQSGGGLVQPGGSLRLSCVASGFTFSSYAMTWVRQAPGMGLEWVSTISLSGSTIYYADSVKGRF
TISRDNPKNTLYLQMNSLRAEDTAVYYCAEGQGAFDFWGQGTMVTVSSASTKGPSVFPLAPSSKSTSG
GTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK (SEQ ID NO: 952)

>hCDIFA-33 Light Chain
NFMLTQPPSASGTPGQRVTISCSGSTSNIGGNTVNWYQQLPGTAPKLLIYSNIQRPSGVPDRFSGSKS
GTSASLAIRGLRSEDEADYYCSTWDDSRKGWFGGGTKLTVLGQPKZXAPSVTLFPPSSEELQANKATL
VCLISDFYPGAVTVAWKADSSPVKAGVETTTPSKQSNNKYAASSYLSLTPEQWKSHRSYSCQVTHEGS
TVEKTVAPTECS (SEQ ID NO: 953)

>hCDIFA-34 Heavy Chain
QVQLVESGGDLIQPGESLRLSCVASGFTVGSHYMTWVRQAPGKGLEWVSTIYSGGTTKYADSVKGRFT
ISRDNSKNTLFLQMNSLRTEDTAVYFCARGSAFSSSWWLVDFWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSH -continued Sequences relating to monoclonal antibodies EDPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK (SEQ ID NO: 954)

>hCDIFA-34 Light Chain
SYELTQPPSVSVAPGKTARITCEDNYVGGNNVHWYQQKPGQAPVLVVSDDNARPSGIPERVSGSKSGN
TATLIINRVEVGDEADFYCQVWDSSRDRVLFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS (SEQ ID NO: 955)

>hCDIFA-35 Heavy Chain
EVQLVQSGGGVVQPGRSLKLSCAASGFSFSSHGMHWVRQAPGKGLEWVALISYDGSYKYYEDSVKGRF
TISRDNSKNTLYLQMNSLRAEDTAVYYCAKDWERYCSGMSCYLRNSLDYWGQGTLVTVSSASTKGPSV
FPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPV
LDSDGSFFLYSKLTVDKSRWQQGNVFSCSVMHEALHNHYTQKSLSLSPGK (SEQ ID NO: 956)

>hCDIFA-35 Light Chain
QSALTQPPSVSVAPGKTAGITCGGPNIGSKSVHWYQRKPGQAPVLVVYDDRYRPSGIPERFSGSNSGN
TATLSISRVEAGDEADYYCQVWDSRSDHVVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS (SEQ ID NO: 957)

>hCDIFA-36 Heavy Chain
QVQLVQSGGGLVQPGRSLRLSCAASGFAFDDYALHWVRQVPGKGLEWVSGISWNSDSIAYADSVKGRF
TISRDNAKNSLYLQMNGLRAEDTALYYCAKDRTIASAGIPDEFQHWGQGTLVTVSSASTKGPSVFPLA
PSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGK (SEQ ID NO: 958)

>hCDIFA-36 Light Chain
DIVMTQSPATLSVSPGERATLSCRASQSVSYKVAWYQQKPGQAPRLLIYGASTRDTGIPARFSGSGSG
TDFTLTISSLQSEDSAVYYCQQYSNWPTTFGQGTKVEIKRTVAAPSVFIFPPSDEQLKSGTASVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 959)

>hCDIFA-37 Heavy Chain
QVQLLESGPGLVKTSGTLSLTCSVSGDSVSTNNWWTWVRQPPGKGLEWIGEIYYNGNTIYNPSFKSRV
TISVNRSKNHFSLKLNSVTAADRAVYYCARRTWNDVGPFDYWGQGILVTVSSASTKGPSVFPLAPSSK
STSGGTAALGCLVKDYFPEPVTVSWNSGALTSGVHTFPAVLQSSGLYSLSSVVTVPSSSLGTQTYICN
VNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTIS
KAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 960)

>hCDIFA-37 Light Chain
DIVMTQSPSSLSASIGDRVIITCRASQNINRYLNWYQQTAGKAPKLLIYGTSNLQSGVPSRFSGSGSG
SGTDFTLTISSLQPEDFATYYCHQSYRTPQTFGQGTKLEIKRTVAAPSVFIFPPSDEQLKSGTASVVC
LLNNFYPREAKVQWKVDNALQSGNSQESVTEQDSKDSTYSLSSTLTLSKADYEKHKVYACEVTHQGLS
SPVTKSFNRGEC (SEQ ID NO: 961)

>hCDIFA-38 Heavy Chain
QVQLVESGPALVKPTQTLTLTCTFSGFSLSSIGMCVSWIRQPPGKALEWLARIDWDDSKYYSPSLQAR
LAISKDTSKNQVVLTMTNVDPMDAGTYYCARTSATLTGPSRVFDYWGQGSLVTVSSASTKGPSVFPLA
PSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGK (SEQ ID NO: 962)

>hCDIFA-38 Light Chain
DVVMTQSPATLSVSPGERATLSCRASQSVRFNLAWYQQKPGQAPRLLISGASTRATGIPARFSGSGSG
TEFTLTISSLQSEDFAVYYCQQYNNWPPLTFGGGTKVEIKRTVAAPSVFIFPPSDEQLKSGTASVVCL
LNNFYPREAKVQWKVDNALQSGNSQESVTEQDSKDSTYSLSSTLTLSKADYEKHKVYACEVTHQGLSS
PVTKSFNRGEC (SEQ ID NO: 963)

>hCDIFA-39 Heavy Chain
QVQLQESGPGLVKPSETLSLTCTLSGGSISSDNYYWGWVRQPPGKGLEWIGSIYYSGSTYYNPSLKSR
VFISVDMSKNQFSLKLSSVTAADTAVYYCARHTQGLGILRYFDWWTRPFDYWGQGTLVTVSSASTKGP
SVFPLAPSSKSTSGGTAALGCLVKDYFPEPVTVSWNSGALTSGVHTFPAVLQSSGLYSLSSVVTVPSS
SLGTQTYICNVNHKPSNTKVDKKVEPKSCDKTHTCPPCPAPELLGGPSVFLFPPKPKDTLMISRTPEV -continued

---

Sequences relating to monoclonal antibodies

---

TCVVVDVSHEDPEVKFNWYVDGVEVHNAKTKPREEQYNSTYRVVSVLTVLHQDWLNGKEYKCKVSNKA
LPAPIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK (SEQ ID NO:
964)

>hCDIFA-39 Light Chain
DIQMTQSPSSLSASVGDRVTITCRASQNINTYLSWYRQKPGKAPELLIYAASNLQSGVPSRFSGSGSG
TDFTLTIHSLQPEDFATYYCQQSYTTLTFGGGTKVEIKRTVAAPSVFIFPPSDEQLKSGTASVVCLLN
NFYPREAKVQWKVDNALQSGNSQESVTEQDSKDSTYSLSSTLTLSKADYEKHKVYACEVTHQGLSSPV
TKSFNRGEC (SEQ ID NO: 965)

>hCDIFA-40 Heavy Chain
QVQLVESGGGVVQPGRSLRLSCAASGFTFSSYAMHWVRQAPGKGLEWVAVISYDGSNKYYADSVKGRF
TISRDNSKNTLYLQMNSLRAEDTAVYYCAGTLRGRGAFDIWGQGTTVTVSSASTKGPSVFPLAPSSKS
TSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHED
PEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFL
YSKLTVDKSRWQQGNVFSCSVMHEALHNHYTQKSLSLSPGK (SEQ ID NO: 966)

>hCDIFA-40 Light Chain
EIVMTQSPSSLSASVGDRVTITCRASQSISSYLNWYQQKPGKAPKLLIYAASSLQSGVPSRFSGSGSG
TDFTLTISSLQPEDFATYYCQQSYSTPVTFGQGTKVDIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 967)

>hCDIFA-41 Heavy Chain
QVQLQESGPGLVKPSQTLSLTCTVSGDSISSNQYYWTWIRQPAGKGLEWIGQIESAYFTNYNPSLKGR
VTISGDASKNVLSLTLTSVTAADTALYWCAREAGGGLGYCTGGRCQFSGYYYYGLDVWGQGTTVTVSS
ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPELLGGPSVFLFPPKPKDTLMI
SRTPEVTCVVVDVSHEDPEVKFNWYVDGVEVHNAKTKPREEQYNSTYRVVSVLTVLHQDWLNGKEYKC
KVSNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQKSLSLSPGK (SEQ ID
NO: 968)

>hCDIFA-41 Light Chain
QSALTQPPSVSAAPGQTVTISCSGSHSNIGNNYVSWYQQLPGTAPRRLIYDTDKRPSGIPDRFSGSKS
GTSATLVITGLRAGDEADYYCGTWDGSLSAGVFGGGTKLTVLGQPKAAPSVTLFPPSSEELQANKATL
VCLISDFYPGAVTVAWKADSSPVKAGVETTTPSKQSNNKYAASSYLSLTPEQWKSHRSYSCQVTHEGS
TVEKTVAPTECS (SEQ ID NO: 969)

>hCDIFA-42 Heavy Chain
QVQLQQSGPGLVKPSETLSLTCTVSGGSISSQYWSWIRQPPGKGLEWIGYIYYSGGTNYNPSLKSRVT
ISVDTSKNQFSLKLTSVTAADTAVYYCARDYFYYMDVWGKGTTVTVSSASTKGPSVFPLAPSSKSTSG
GTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK (SEQ ID NO: 970)

>hCDIFA-42 Light Chain
DIVMTQSPGTLSLSPGERATLSCRASQSVDSSFLAWYQQKPGQAPRLLIYGASSRATGIPDRFSGSGS
ETDFTLTISRLEPEDFAVYYCQQYGSSRSFGGGTKVEIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 971)

>hCDIFA-43 Heavy Chain
QVQLVQSGPVLVKPTETLMLTCTVSGFSLSSAGMGVSWIRQPPGKAPEWLAHIFLSDEKSYRTSLESR
LTISKDTSKSQVVLIMTNVDPADTATYYCARALKRYCTGGVCFLNWFDSWGPGTVVTVSSASTKGPSV
FPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPV
LDSDGSFFLYSKLTVDKSRWQQGNVFSCSVMHEALHNHYTQKSLSLSPGK (SEQ ID NO: 972)

>hCDIFA-43 Light Chain
DIVMTQSPGTLSLSPGERATLSCRASLSIGNLYLAWYKQRPGHPPRLLIYGASSRATGTPDRFSGSGS
GTDFTLTISRLEPEDFVVYYCQQYKTSPWTFGQGTKVEIKRTVAAPSVFIFPPSDEQLKSGTASVVCL
LNNFYPREAKVQWKVDNALQSGNSQESVTEQDSKDSTYSLSSTLTLSKADYEKHKVYACEVTHQGLSS
PVTKSFNRGEC (SEQ ID NO: 973)

>hCDIFA-44 Heavy Chain
QITLKESGPALVKPTQTLKLTCTFSGFSLSTTGMCVTWIRQPPGKALEWLARIDWDDNTYYSTSLKTR
LTITKDTSNNQVVLTMTNMDPMDTATYYCARMIPPPHRGAFDIWGQGTTVTVSSASTKGPSVFPLAPS
SKSTSGGTAALGCLVKDYFPEPVTVSWNSGALTSGVHTFPAVLQSSGLYSLSSVVTVPSSSLGTQTYI
CNVNHKPSNTKVDKKVEPKSCDKTHTCPPCPAPELLGGPSVFLFPPKPKDTLMISRTPEVTCVVVDVS Sequences relating to monoclonal antibodies

```
HEDPEVKFNWYVDGVEVHNAKTKPREEQYNSTYRVVSVLTVLHQDWLNGKEYKCKVSNKALPAPIEKT
ISKAKGQPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK (SEQ ID NO: 974)

>hCDIFA-44 Light Chain
EIVLTQSPATLSVSPGERVTLSCRASQSVRGNLAWYQQKPGQVPRLLIFGASTRATGIPARFSGSGSG
TEFTLTISSLQSEDFAVYYCQQYNKWPPYTFGQGTKLEIKRTVAAPSVFIFPPSDEQLKSGTASVVCL
LNNFYPREAKVQWKVDNALQSGNSQESVTEQDSKDSTYSLSSTLTLSKADYEKHKVYACEVTHQGLSS
PVTKSFNRGEC (SEQ ID NO: 975)

>hCDIFA-45 Heavy Chain
QVQLVQSGPEVRKPGTSVKFSCKASGFTFTSAAMQWVRQARGQRLEWIGWIVVDSGNTNYAQKFQERV
TITRDMSTSTVYMELSSLRSEDTAMYYCAASRGIVGTRGLFDSWGQGTLVTVSSASTKGPSVFPLAPS
SKSTSGGTAALGCLVKDYFPEPVTVSWNSGALTSGVHTFPAVLQSSGLYSLSSVVTVPSSSLGTQTYI
CNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIEKT
ISKAKGQPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK (SEQ ID NO: 976)

>hCDIFA-45 Light Chain
EIVLTQSPSSLSSSVGDRVTITCRASQSIRNYLNWYQQKPGKAPKLLIYGASSLQSGVPPRFSGSGFG
TDFTLTISNLQPEDFASYSCQQTYSTPLTFGGGTKLEIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 977)

>hCDIFA-46 Heavy Chain
EVQLVESGGGLVQPGGSLRLSCAASGFTVSRNYMTWVRQAPGKGLEWVSVIYSGGSTYHADSVKGRFT
ISRDNSKNTLNLQMSSLRAEDTAVYYCARPCPGSSISCDYNMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTY
ICNVNHKPSNTKVDKKVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALPAPIEK
TISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK (SEQ ID NO: 978)

>hCDIFA-46 Light Chain
QAVVTQPASVSGSPGQSITISCTGTSSDVGGYNYVSWYQQHPGKAPKLIIYEVSNRPSGVSNRFSGSK
SGNTASLTISGLQAEDEADYYCTSYTSSSMIDVFGTGTKLTVLGQPKAAPSVTLFPPSSEELQANKAT
LVCLISDFYPGAVTVAWKADSSPVKAGVETTTPSKQSNNKYAASSYLSLTPEQWKSHRSYSCQVTHEG
STVEKTVAPTECS (SEQ ID NO: 979)

>hCDIFA-47 Heavy Chain
QVQLQESGAEVKKPGSSVKVSCQASGGTFSNYAFNWVRQAPGQGLEWMGRTIPIVGLVNYAQNFQGRI
TFSADKSTSTAYMEVNSLRSDDTAVYYCARAEYPLNCTRGNCDVGTSYHYYYGMGVWGRGTTVTVSSA
STKGPSVFPLAPSSKSTSGGTAALGCLVKDYFPEPVTVSWNSGALTSGVHTFPAVLQSSGLYSLSSVV
TVPSSSLGTQTYICNVNHKPSNTKVDKKVEPKSCDKTHTCPPCPAPELLGGPSVFLFPPKPKDTLMIS
RTPEVTCVVVDVSHEDPEVKFNWYVDGVEVHNAKTKPREEQYNSTYRVVSVLTVLHQDWLNGKEYKCK
VSNKALPAPIEKTISKAKGQPREPQVYTLPPSREEMTKNQVSLTCLVKGFYPSDIAVEWESNGQPENN
YKTTPPVLDSDGSFFLYSKLTVDKSRWQQGNVFSCSVMHEALHNHYTQKSLSLSPGK (SEQ ID
NO: 980)

>hCDIFA-47 Light Chain
EIVMTQSPATLSVSPGERATLSCRASQSISSNLAWFQQKPGQAPRLLIHGASTRATGIPVRFSGSGSG
TEFTLTISSLQFGDSAVYYCQQYYNWRYTFGQGTKLEIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 981)

>hCDIFA-48 Heavy Chain
QVQLVQSGAEVKKPGASVKVSCKASGYTFTTYAMHWVRQAPGHRLEWMGWINPVNGNSKHSQNFQGRV
TITRDTSASTVYMELSSLRSEDTAVYYCARDTSSGVILANNFDYWGQGTLVTVSSASTKGPSVFPLAP
SSKSTSGGTAALGCLVKDYFPEPVTVSWNSGALTSGVHTFPAVLQSSGLYSLSSVVTVPSSSLGTQTY
ICNVNHKPSNTKVDKKVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALPAPIEK
TISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK (SEQ ID NO: 982)

>hCDIFA-48 Light Chain
DIVMTQSPATLSLSPGERATLSCRASQSVDSYLTWYQQKPGQAPRLLIYDSSNRATGIPARFSGSGSG
TDFTLTISSLEPEDFAVYYCHQRSNWPNTFGQGTKVEIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 983)

>hCDIFA-49 Heavy Chain
QVQLQESGPRLLEPSETLSLSCTVSGGSITSYYWGWIRQSPGKGLQWIGHIDSSGNTNYNYNSSLMNR
VTISVVTSKNQFSLKLTSVTPADSAVYYCARVYLFYFGQSKWEYFDSWGQGTLVTVSSASTKGPSVFP
LAPSSKSTSGGTAALGCLVKDYFPEPVTVSWNSGALTSGVHTFPAVLQSSGLYSLSSVVTVPSSSLGT
QTYICNVNHKPSNTKVDKKVEPKSCDKTHTCPPCPAPELLGGPSVFLFPPKPKDTLMISRTPEVTCVV
```

-continued

Sequences relating to monoclonal antibodies

```
VDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLD
SDGSFFLYSKLTVDKSRWQQGNVFSCSVMHEALHNHYTQKSLSLSPGK (SEQ ID NO: 984)

>hCDIFA-49 Light Chain
QSALTQPPSVSGAPGQRVTISCTGSDSNIGTDYDVHWYKQVPGAAPKLLIYGINNRPSGVPDRFSGSK
SGTSASLAITGLQAEDEGDYYCQSYDIRPSGSVVFGGGTKLTVLGQPKAAPSVTLFPPSSEELQANKA
TLVCLISDFYPGAVTVAWKADSSPVKAGVETTTPSKQSNNKYAASSYLSLTPEQWKSHRSYSCQVTHE
GSTVEKTVAPTECS (SEQ ID NO: 985)

>hCDIFA-50 Heavy Chain
QVQLVQSGTEVKKPGASVKVSCKASGYTFTNYG1SWVRQAPGQGLEWMGWISGNNGHTNYAQNLQGRV
TMTTDTSTSTAYMELRSLRSDDTAVYYCARVTRWFGELLGDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPKREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK (SEQ ID NO: 986)

>hCDIFA-50 Light Chain
QTVVTQEPSLTVSPGGTVTLTCASSTGAVTSGFLPNWFQQKPGQAPRALIYNTNNKHSWTPARFSGSL
LGGKAALTLSGVQPEDEAEYYCLLYFDDAQVQVFGGGTKLTVLGQPKAAPSVTLFPPSSEELQANKAT
LVCLISDFYPGAVTVAWKADSSPVKAGVETTTPSKQSNNKYAASSYLSLTPEQWKSHRSYSCQVTHEG
STVEKTVAPTECS (SEQ ID NO: 987)

>hCDIFA-51 Heavy Chain
EVQLLESGGGVVQPGRSLRLSCAASGFTFSNYGMHWVRQAPGKGLEWVAVIWYDGSNKYYADSVKGRF
TISRDNSKNMVYLQMNSLRGADTAVYYCAGDRHLGLWGYYYYYYAMDVWGQGTTVTVSSASTKGPSVF
PLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPELLGGPSVFLFPPKPKDTLMISRTPEVTCV
VVDVSHEDPEVKFNWYVDGVEVHNAKTKPREEQYNSTYRVVSVLTVLHQDWLNGKEYKCKVSNKALPA
PIEKTISKAKGQPREPQVYTLPPSREEMTKNQVSLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 988)

>hCDIFA-51 Light Chain
QAVVTQPPSVSAAPGQRVTISCSGSSSNIGKNYVSWYQHLPGTAPKLLIYESNKRPSGIPDRFSGSKS
GTSATLGITGLQTGDEADYYCGTWDSSLSAGLFGGGTKVTVLGQPKAAPSVTLFPPSSEELQANKATL
VCLISDFYPGAVTVAWKADSSPVKAGVETTTPSKQSNNKYAASSYLSLTPEQWKSHRSYSCQVTHEGS
TVEKTVAPTECS (SEQ ID NO: 989)

>hCDIFA-52 Heavy Chain
EVQLVESGGGLVQPGRSLRLSCAASGFTFDDYAMHWVRQAPGKGLEWVSGISWNSDSIAYADSVKGRF
TISRDNAKNSLYLQMNSLRAEDTALYYCAKDWGIAGAGIPDYFDYWGQGTLVTVSSASTKGPSVFPLA
PSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGK (SEQ ID NO: 990)

>hCDIFA-52 Light Chain
QAVVTQPPSASGTPGQRVTISCSGSNSNIGSNTVNWYQQLPGTAPKLLIYDNNQRPSGVPDRFSASKS
GASASLAISGLQSEDEADYYCAAWDNNLNGLFGGGTKVTVLGQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS (SEQ ID NO: 991)

>hCDIFA-53 Heavy Chain
QVQLQQSGPGLVKPSETLSLTCTLSGGSISSDNYYWGWVRQPPGKGLEWIGSIYYSGSTYYNPSLKSR
VF1SVDMSKNQFSLKLSSVTAADTAVYYCARHTQGLGILRYFDWWTRPFDYWGQGTLVTVSSASTKGP
SVFPLAPSSKSTSGGTAALGCLVKDYFPEPVTVSWNSGALTSGVHTFPAVLQSSGLYSLSSVVTVPSS
SLGTQTYICNVNHKPSNTKVDKKVEPKSCDKTHTCPPCPAPELLGGPSVFLFPPKPKDTLMISRTPEV
TCVVVDVSHEDPEVKFNWYVDGVEVHNAKTKPREEQYNSTYRVVSVLTVLHQDWLNGKEYKCKVSNKA
LPAPIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK (SEQ ID NO:
992)

>hCDIFA-53 Light Chain
QSALTQPASVSGSPGQSITISCTGTSSDVGSYNLVSWYQQHPGKAPKLMIYEGSKRPSGVSNRFSGSK
SGNTASLTISGLQAEDEADYYCCSYAGSSTLFGGGTKLTVLGQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS (SEQ ID NO: 993)

>hCDIFA-54 Heavy Chain
QVQLVESGAEVKKPGASVKVSCKASGYTFTSYDINWVRQATGQGLEWMGWMNPNSGNTGYAQKFQGRV
TMTRNTSISTAYMELSSLRSEDTAVYYCARGGPNSGSFSHWFDPWGQGTLVTVSSASTKGPSVFPLAP
SSKSTSGGTAALGCLVKDYFPEPVTVSWNSGALTSGVHTFPAVLQSSGLYSLSSVVTVPSSSLGTQTY
ICNVNHKPSNTKVDKKVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALPAPIEK
```

-continued

| Sequences relating to monoclonal antibodies |
| --- |

TISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK (SEQ ID NO: 994)

>hCDIFA-54 Light Chain
QAVVTQPPSASASLGASVTLTCTLSSGYSNYKVDWYQQRPGKGPRFVMRVGTGGIVGSKGDGIPDRFS
VLGSGLNRYLTIKNIQEDDESDYHCGADHGSGSNFAVVFGGGTKLTVLGQPKAAPSVTLFPPSSEELQ
ANKATLVCLISDFYPGAVTVAWKADSSPVKAGVETTTPSKQSNNKYAASSYLSLTPEQWKSHRSYSCQ
VTHEGSTVEKTVAPTECS (SEQ ID NO: 995)

>hCDIFA-55 Heavy Chain
EVQLLESGAEVKKPGASVKVSCKASAYTFTTYGINWVRQAPGQGLEWMGWVSFSNGNTEYAQKFQGRV
TMTTDTSTSTAFMELRSLRSDDTAVYYCASEKGELLSGCFDPWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK (SEQ ID NO: 996)

>hCDIFA-55 Light Chain
QSVLTQPPSVSAAPGQKVTISCSGSSSNIGNSLVSWYQHLPGTAPKLLISDNNERPSGIPDRFSGSKS
GTSATLGITGLQTGDEADYYCGTWDSSLSVWFGGGTKLTVLGQPKZXAPSVTLFPPSSEELQANKATL
VCLISDFYPGAVTVAWKADSSPVKAGVETTTPSKQSNNKYAASSYLSLTPEQWKSHRSYSCQVTHEGS
TVEKTVAPTECS (SEQ ID NO: 997)

>hCDIFA-56 Heavy Chain
QVQLVQSGAEVKKPGASVKVSCKVSGYTLPELSMHWVRQAPGKGLEWMGGFDPEDDDTIYAQKFQGRV
TMTEDTSTDTAYLELSSLRSEDTAVYYCATDSSPLYNENYFGSAAFDVWGQGTTVTVSSASTKGPSVF
PLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPELLGGPSVFLFPPKPKDTLMISRTPEVTCV
VVDVSHEDPEVKFNWYVDGVEVHNAKTKPREEQYNSTYRVVSVLTVLHQDWLNGKEYKCKVSNKALPA
PIEKTISKAKGQPREPQVYTLPPSREEMTKNQVSLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 998)

>hCDIFA-56 Light Chain
AIRMTQSPSSLSASVGDRVTITCRASQGISTYLAWYQQKPGKAPKLLLYAASRLESGVPSRFSGSGSG
TDYTLTINSLQPEDFATYYCQQYDRMPRTFGQGTKVEIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 999)

>hCDIFA-57 Heavy Chain
QVQLVESGAEVKKPGASVKVSCKASGYTFTGYYMHWVRQAPGQGLEWMGWINPNSGGTNYAQKFQGRV
TMTRDTSISTAYMELSRLRSDDTAVYYCAREGTWGVSAFDIWGQGTMVTVSSASTKGPSVFPLAPSSK
STSGGTAALGCLVKDYFPEPVTVSWNSGALTSGVHTFPAVLQSSGLYSLSSVVTVPSSSLGTQTYICN
VNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTIS
KAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 1000)

>hCDIFA-57 Light Chain
DIVMTQSPGTLSLSPGERATLSCRASQSVSSSYLAWYQQKPGQAPRLLIYGASSRATGIPDRFSGSGS
GTDFTLTISRLEPEDFAVYYCQQYGSSLTFGGGTKVEIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 1001)

>hCDIFA-58 Heavy Chain
QVQLVESGGGVVQPGRSLRLSCAASGFVFSSYGMHWVRQAPGMGLEWVAIISYDGSNKYYADSVKGRF
TISRDNSKNRLYLQMSSLRADDSAVYYCAKDLDDSNALADYWGLGTLVTVSSASTKGPSVFPLAPSSK
STSGGTAALGCLVKDYFPEPVTVSWNSGALTSGVHTFPAVLQSSGLYSLSSVVTVPSSSLGTQTYICN
VNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTIS
KAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 1002)

>hCDIFA-58 Light Chain
DILLTQSPSSLAAIVGDRVTISCRASQAINSALAWYQQRPGKAPKLLLYGRSRLNSGVSSRFSGSGSG
TDYTLTISSLQPEDFATYYCQQYYSNPPWTFGQGTKVDIKRTVAAPSVFIFPPSDEQLKSGTASVVCL
LNNFYPREAKVQWKVDNALQSGNSQESVTEQDSKDSTYSLSSTLTLSKADYEKHKVYACEVTHQGLSS
PVTKSFNRGEC (SEQ ID NO: 1003)

>hCDIFA-59 Heavy Chain
QVQLVESGGGLVQPGRSLRLSCRTSGFTFGDFALSWVRQAPGKGLEWVGYIRSKTFGGTTEYAASVKG
RFTMSRDDSKSIAYLQMNSLKTEDTAVYFCTRASYGAFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHED
PEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFL
YSKLTVDKSRWQQGNVFSCSVMHEALHNHYTQKSLSLSPGK (SEQ ID NO: 1004)

-continued

---

Sequences relating to monoclonal antibodies

---

>hCDIFA-59 Light Chain
DIVMTQSPSSLSASVGDTVTITCRAGQNIATYLHWYQQKPGKAPNLLIYDARTLQSGVPSRFSGSGSG
TDFTLTINSLQPEDFATYYCQQSYNTPWTFGQGTKVEIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 1005)

>hCDIFA-60 Heavy Chain
QVQLQQSGAEVKRPGASVIVSCKASGYTFSGYYINWVRQAPGQGLQWMGWIDPSSGETHYVEKFRGRV
AMTRDLSLSTTYMDLSRLRSDDTALYYCARVVDAHHIDVWGQGTMVTVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGK (SEQ ID NO: 1006)

>hCDIFA-60 Light Chain
DVVMTQSPGTLSLSPGERATLSCRASQRISSSFLAWYQQKPGRAPRLLIYVASNRATGIPDRFSGSGS
GTDFTLTISRLEPEDFAVYFCLQYGDSPYTFGQGTKVEIKRTVAAPSVFIFPPSDEQLKSGTASVVCL
LNNFYPREAKVQWKVDNALQSGNSQESVTEQDSKDSTYSLSSTLTLSKADYEKHKVYACEVTHQGLSS
PVTKSFNRGEC (SEQ ID NO: 1007)

>hCDIFA-61 Heavy Chain
QVQLQESGPGLMKPSETLSLTCTVSGGSITDDYWSWIRQPPGKGLEWIGYIYYTGSSNYNPSLKSRVT
ISVDTSKNQFSLNLSSVTAADTAVYYCARHSHGGFDPWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK (SEQ ID NO: 1008)

>hCDIFA-61 Light Chain
DIQMTQSPSSLSASVGDRVTVTCRASQDISNSLAWYQQKPGKAPLLLLYAASTLESGVPSRFSGSGSG
TDYTLTISSLQPEDFATYYCQQYYNTQYTFGQGTKLEIKRTVAAPSVFIFPPSDEQLKSGTASVVCLL
NNFYPREAKVQWKVDNALQSGNSQESVTEQDSKDSTYSLSSTLTLSKADYEKHKVYACEVTHQGLSSP
VTKSFNRGEC (SEQ ID NO: 1009)

>hCDIFB-1 VH
EVQLVESGGGLVKPGGSLKLSCAASGFSFSTYTMNWVRQIPGKGLEWISSISSSTNYIYYADSVKGRF
TISRDNTKNSLHLQMNSLRAEDTAVYYCARVNPLRYFDNWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGK (SEQ ID NO: 1010)

>hCDIFB-1 VL
DIVMTQSPSSLSASVGDRVTITCRASQRIATYLSWYQQKPGKAPKLLIFDASTLQSGVPSRFSGSGSG
TDFTLTISGLQPEDLATYYCQQSSSTHLTFGGGTKVEIKRTVAAPSVFIFPPSDEQLKSGTASVVCL
LNNFYPREAKVQWKVDNALQSGNSQESVTEQDSKDSTYSLSSTLTLSKADYEKHKVYACEVTHQG
LSSPVTKSFNRGEC (SEQ ID NO: 1011)

>hCDIFB-2 VH
QVQLVESGGGLVQPGGSLRLSCAASGFTFSSYWMSWVRQAPGKGLEWVANIKQDGSEKYYVDSVKGRF
TISRDNAKNSLYLQMNSLRAEDTAVYYCARDRKRYCSSTSCQRSGFDYWGQGTLVTVSSASTKGPSVF
PLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPELLGGPSVFLFPPKPKDTLMISRTPEVTCV
VVDVSHEDPEVKFNWYVDGVEVHNAKTKPREEQYNSTYRVVSVLTVLHQDWLNGKEYKCKVSNKALPA
PIEKTISKAKGQPREPQVYTLPPSREEMTKNQVSLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 1012)

>hCDIFB-2 VL
EIVLTQSPATLSLSPGERATLSCRASQSVSSYLAWYQQKPGQAPRLLIYDASNRATGIPARFSGSGSG
TDFTLTISSLEPEDFAVYYCQQRSNWPITFGQGTRLEIKRTVAAPSVFIFPPSDEQLKSGTASVVCL
LNNFYPREAKVQWKVDNALQSGNSQESVTEQDSKDSTYSLSSTLTLSKADYEKHKVYACEVTHQG
LSSPVTKSFNRGEC (SEQ ID NO: 1013)

>hCDIFB-3 VH
QVQLQESGPGLVKPSETLSLTCSVSGGSVKSSYWNWIRQSPGKEPEWIGYIYYTGSTNYNPSLKSRVT
MSMDTSKNQFSLKLSSVTAADTAVYYCARVFGVRDYNKGAYYYMDVWGKGTTVTVSSASTKGPSVFP
LAPSSKSTSGGTAALGCLVKDYFPEPVTVSWNSGALTSGVHTFPAVLQSSGLYSLSSVVTVPSSSLGT
QTYICNVNHKPSNTKVDKKVEPKSCDKTHTCPPCPAPELLGGPSVFLFPPKPKDTLMISRTPEVTCVV
VDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLD
SDGSFFLYSKLTVDKSRWQQGNVFSCSVMHEALHNHYTQKSLSLSPGK (SEQ ID NO: 1014)

-continued

| Sequences relating to monoclonal antibodies |
| --- |

```
>hCDIFB-3 VL
DIVMTQSPGTLSLSPGDRATLSCRASQTLVSNSLAWYQQKPGQAPRLLIYGASTRAIGIPDRFSGGGS
GTDFTLTISRLESEDFGMYYCHQSGNSPRGTFGQGTKLEIKRTVAAPSVFIFPPSDEQLKSGTASVV
CLLNNFYPREAKVQWKVDNALQSGNSQESVTEQDSKDSTYSLSSTLTLSKADYEKHKVYACEVTH
QGLSSPVTKSFNRGEC (SEQ ID NO: 1015)

Epitope sequences
>hCDIFA-2
FNHLSESKKYGP (SEQ ID NO: 1016)
AMEGGSGHTVTGNIDHFFS (SEQ ID NO: 1017)
SLENDGTRLLD (SEQ ID NO: 1018)

>hCDIFA-3
SQINKPTVPTIDD (SEQ ID NO: 1019)
LNIYSQELLN (SEQ ID NO: 1020)

>hCDIFA-4
VNNELILHDK (SEQ ID NO: 1021)
FSSPSISSHIPSLSIYSA (SEQ ID NO: 1022)

>hCDIFA-6
AMEGGSGHTVTGNIDHF (SEQ ID NO: 1023)

>hCDIFA-7
IVYQSKFLTLN (SEQ ID NO: 1024)

>hCDIFA-8
FGVDGVKAPGIYG (SEQ ID NO: 1025)

>hCDIFA-9
LSIYSAIGIETENL (SEQ ID NO: 1026)

>hCDIFA-11
LNQHLNPAIESDNNFTDTTKIFHDSLFNSATAEN (SEQ ID NO: 1027)

>hCDIFA-12
IEGQAILYQNEF (SEQ ID NO: 1028)

>hCDIFA-13
SIYSAIGIETE (SEQ ID NO: 1029)

>hCDIFA-14
YPISTNINLSK (SEQ ID NO: 1030)
KDVLSKIDINKNKLIIGNQTI (SEQ ID NO: 1031)

>hCDIFA-15
SFEY (SEQ ID NO: 1032)
RYLEESNKKILQKI (SEQ ID NO: 1033)
SIDFKDIKKLSLGYIMSNFK (SEQ ID NO: 1034)

>hCDIFA-16
IVYQSKFLTLNGKKYYFDNDSK (SEQ ID NO: 1035)
IVYQSKFLTLNGKKYYFDNNSK (SEQ ID NO: 1036)

>hCDIFA-17
LTLNGKKYYFDNDSKAVTGWRIINNEKYYFNPNNAIA (SEQ ID NO: 1037)
LTLNGKKYYFGSDSKAVTGWRIINNKKYYFNPNNAIAAIHL (SEQ ID NO: 1038)

>hCDIF-23
GVIYFFGVDGVKAPGIYG (SEQ ID NO: 1039)

>hCDIFA-24
HLNPAIESDNNFTDTTKI (SEQ ID NO: 1040)
LLDASVSPDTKFILN (SEQ ID NO: 1041)

>hCDIFA-25
SSTTEALQLLE (SEQ ID NO: 1042)
VSEYNRDETVL (SEQ ID NO: 1043)

>hCDIFA-26
IKQWADINAEYN (SEQ ID NO: 1044)
RKINSNHGIDIRANSLFT (SEQ ID NO: 1045)

>hCDIFA-27
STTEA (SEQ ID NO: 1046)
VSEYNRDETVL (SEQ ID NO: 1047)
```

Sequences relating to monoclonal antibodies

>hCDIFA-28
ISIENGTIKKGKLIKDVLSKIDINKNKLIIG (SEQ ID NO: 1048)

>hCDIFA-29
IVYQSKFLTLNGKKYY (SEQ ID NO: 1049)
AIVYQNKFLTLNGKKYYFDNDSKAVTGWQTIDGKKYYFNLNTAEA (SEQ ID NO: 1050)
GWQTIDGKKYYFNLN (SEQ ID NO: 1051)
SKAVTGWQTINGKVYYFMPDTAM (SEQ ID NO: 1052)

>hCDIFA-30
AATGWQTIDGKKYYFNTNTAEAATGWQTIDGKKYYFNTNTAI (SEQ ID NO: 1053)
AATGWQTIDGKKYYFNLNTAEAATGWQTIDGKKYYFNTNTF (SEQ ID NO: 1054)

>hCDIFA-32
INKSNGESVYVETEKEIF (SEQ ID NO: 1055)
LVNLISNAVNDTI (SEQ ID NO: 1056)

>hCDIFA-33
IKQWADINAEYNIKL (SEQ ID NO: 1057)
RKINSNHGIDIRANSLFT (SEQ ID NO: 1058)

>hCDIFA-34
YFAPANTDANNIEGQAIRYQNRFLHL (SEQ ID NO: 1059)

>hCDIFA-35
EVRINSEGRKELLAHSGKWINKEEAIMSDLSSK (SEQ ID NO: 1060)

>hCDIFA-36
TILTNLDEYNKLTTNNNENKYLQLKKL (SEQ ID NO: 1061)

>hCDIFA-37
FGVDGVKAPGIYG (SEQ ID NO: 1062)

>hCDIFA-38
YKSQINKPTVPTIDD (SEQ ID NO: 1063)
EQELLNIYSQEL (SEQ ID NO: 1064)

>hCDIFA-39
KPVYEDTNI (SEQ ID NO: 1065)
SYPISTNI (SEQ ID NO: 1066)

>hCDIFA-42
GHTVTGNIDHFFS (SEQ ID NO: 1067)
FYAFFDY (SEQ ID NO: 1068)

>hCDIFA-43
EDISKNNSTYSVRFINKSNGESV (SEQ ID NO: 1069)
TGLNTIYDSI (SEQ ID NO: 1070)

>hCDIFA-44, -45
YKSQINKPTVPTIDD (SEQ ID NO: 1071)
EQELLNIYSQEL (SEQ ID NO: 1072)

>hCDIFA-46
WADINAEYNI (SEQ ID NO: 1073)
SLRKINSNHGIDIRANSL (SEQ ID NO: 1074)

>hCDIFA-48
QLFSTGLNTIY (SEQ ID NO: 1075)
SKIDINKNKLIIGNQTI (SEQ ID NO: 1076)

>hCDIFA-50
TIDGKKYYFNTNTFIAST (SEQ ID NO: 1077)
LTLNGKKYYFGSDSKAVTGL (SEQ ID NO: 1078)

>hCDIFA-54
SGHTVTGNIDHF (SEQ ID NO: 1079)
SLENDGTRL (SEQ ID NO: 1080)

>hCDIFA-55
LTLNGKKYYFDNDSKAVTGWRIINNEKYYFNPNNAIAA (SEQ ID NO: 1081)
LTLNGKKYYFDNNSKAVTGWQTIDSKKYYFNTNTAE (SEQ ID NO: 1082)
LTLNGKKYYFGSDSKAVTGWRIINNKKYYFNPNNAIAA (SEQ ID NO: 1083)

>hCDIFA-57
AATGWQTIDGKKYYFNTNTAE (SEQ ID NO: 1084)

-continued

| Sequences relating to monoclonal antibodies |
| --- |

```
>hCDIFA-58
LVNTLKKAI (SEQ ID NO: 1085)
EYNRDETVLESYRTNSLR (SEQ ID NO: 1086)
YQFEKYVRDYT (SEQ ID NO: 1087)

>hCDIFA-59
IVYQSKFLTLNGKKYYFDND (SEQ ID NO: 1088)
IVYQSKFLTLNGKKYYFDNN (SEQ ID NO: 1089)
IVYQNKFLTLNGKKYYFDND (SEQ ID NO: 1090)
```

The following clauses describe additional embodiments of the invention:

C1. A polypeptide comprising the amino acid sequence selected from the group consisting of SEQ ID NOs: 763-800, wherein the polypeptide comprises a sequence less than 100% identical to SEQ ID NO: 762.

C2. The polypeptide according to clause C1, wherein the polypeptide comprises a mutation.

C3. The polypeptide according to clause C1, wherein the polypeptide comprises three mutations.

C4. The polypeptide according to clause C1, wherein the polypeptide comprises at least one amino acid side chain chemically modified by 1-ethyl-3-(3-dimethyl-aminopropyl) carbodiimide) (EDC).

C5. The polypeptide according to clause C1, wherein the polypeptide comprises at least one amino acid side chain chemically modified by N-Hydroxysuccinimide (NHS).

C6. A polypeptide comprising the amino acid sequence selected from the group consisting of SEQ ID NOs: 802-840, wherein the polypeptide comprises a sequence less than 100% identical to SEQ ID NO: 801.

C7. The polypeptide according to clause C6, wherein the polypeptide comprises a mutation.

C8. The polypeptide according to clause C6, wherein the polypeptide comprises three mutations.

C9. The polypeptide according to clause C6, wherein the polypeptide comprises at least one amino acid side chain chemically modified by 1-ethyl-3-(3-dimethyl-aminopropyl) carbodiimide) (EDC).

C10. The polypeptide according to clause C6, wherein the polypeptide comprises at least one amino acid side chain chemically modified by N-Hydroxysuccinimide (NHS).

C11. A polypeptide comprising any one amino acid sequence selected from the group consisting of SEQ ID NOs: 842-870, and a mutation as compared to the corresponding wild-type toxin.

C12. The polypeptide according to clause C11, wherein the polypeptide comprises at least one amino acid side chain chemically modified by 1-ethyl-3-(3-dimethyl-aminopropyl) carbodiimide) (EDC).

C13. The polypeptide according to clause C11, wherein the polypeptide comprises at least one amino acid side chain chemically modified by N-Hydroxysuccinimide (NHS).

C14. A polypeptide comprising any one amino acid sequence selected from the group consisting of SEQ ID NOs: 871-887, and a mutation as compared to the corresponding wild-type toxin.

C15. The polypeptide according to clause C14, wherein the polypeptide comprises at least one amino acid side chain chemically modified by 1-ethyl-3-(3-dimethyl-aminopropyl) carbodiimide) (EDC).

C16. The polypeptide according to clause C14, wherein the polypeptide comprises at least one amino acid side chain chemically modified by N-Hydroxysuccinimide (NHS).

C17. A composition comprising a polypeptide according to any one of clauses C1-C16; and a pharmaceutically acceptable diluent.

C18. The composition according to clause C17, further comprising an adjuvant.

C19. The composition according to clause C17, further comprising aluminum hydroxide.

C20. The composition according to clause C17, further comprising a CpG oligonucleotide.

C21. The composition according to clause C17, further comprising aluminum hydroxide and a CpG oligo-nucleotide.

C22. An antibody or antigen binding fragment thereof comprising the amino acid sequence set forth in SEQ ID NO: 841.

C23. A method for eliciting an immune response in a human against *Clostridium difficile* expressing a toxin comprising the amino acid sequence selected from the group consisting of SEQ ID NOs: 762-840, the method comprising administering to the human an effective dose of a composition comprising a *C. difficile* toxoid.

C24. The method according to clause C23, comprising administering two doses of the composition to the human.

C25. The method according to clause C23, wherein the first dose and the second dose are administered about 30 days apart.

C26. The method according to clause C24, wherein the first dose and the second dose are administered about 6 months apart.

C27. The method according to clause C23, comprising administering three doses of the composition to the human.

C28. The method according to clause C27, wherein the third dose is administered about 6 months after the first dose.

C29. The method according to clause C23, wherein the human is at least 50 years of age.

C30. The method according to clause C23, wherein the composition comprises a *C. difficile* toxoid A and a *C. difficile* toxoid B, each having a purity of at least 90% or greater.

C31. The method according to clause C23, wherein the composition comprises a *C. difficile* toxoid A and a *C. difficile* toxoid B, in a ratio of about 3:1 to about 1:1.

C32. The method according to clause C23, wherein the composition comprises a *C. difficile* toxoid A and a *C. difficile* toxoid B, in a ratio of 1:1.

C33. The method according to clause C23, wherein the composition comprises an adjuvant.

C34. The method according to clause C23, wherein the composition comprises an aluminum adjuvant.

C35. A method for eliciting an immune response in a human against *Clostridium difficile*, the method comprising administering to the human an effective dose of a composition comprising a *C. difficile* toxoid, wherein the human had a human healthcare contact in 12 months prior to administration of the composition.

C36. The method according to clause C35, wherein the composition comprises a polypeptide having the amino acid sequence set forth in any one of SEQ ID NOs: 1-8, 15, 17, 19, 21, 23, 25, 28-35, 82-761, and 762-840.

C37. A method for eliciting an immune response in a human against *Clostridium difficile*, the method comprising administering to the human an effective dose of a composition comprising a *C. difficile* toxoid, wherein the human received an antibiotic within 12 weeks prior to administration of the composition.

C38. The method according to clause C37, wherein the composition comprises a polypeptide having the amino acid sequence set forth in any one of SEQ ID NOs: 1-8, 15, 17, 19, 21, 23, 25, 28-35, 82-761, and 762-840.

C39. A method for eliciting an immune response in a human against *Clostridium difficile*, the method comprising administering to the human an effective dose of a composition comprising a *C. difficile* toxoid, wherein the human is 50 years of age at the time of administration of the composition.

C40. The method according to clause C39, wherein the composition comprises a polypeptide having the amino acid sequence set forth in any one of SEQ ID NOs: 1-8, 15, 17, 19, 21, 23, 25, 28-35, 82-761, and 762-840.

C41. A polypeptide comprising the amino acid sequence selected from the group consisting of SEQ ID NOs: 763-800, wherein the polypeptide comprises a sequence less than 100% identical to SEQ ID NO: 762, wherein the polypeptide comprises at least one chemically modified amino acid side chain.

C42. A polypeptide comprising the amino acid sequence selected from the group consisting of SEQ ID NOs: 763-800, wherein the polypeptide comprises a sequence less than 100% identical to SEQ ID NO: 762, wherein the polypeptide comprises at least one amino acid side chain chemically modified by 1-ethyl-3-(3-dimethylaminopropyl) carbodiimide) (EDC), and at least one amino acid side chain chemically modified by N-Hydroxysuccinimide (NHS), wherein the polypeptide comprises any one amino acid sequence selected from the group consisting of SEQ ID NOs: 842-870.

C43. A polypeptide comprising the amino acid sequence selected from the group consisting of SEQ ID NOs: 802-840, wherein the polypeptide comprises a sequence less than 100% identical to SEQ ID NO: 801, wherein the polypeptide comprises at least one amino acid side chain chemically modified by 1-ethyl-3-(3-dimethylaminopropyl) carbodiimide) (EDC), and at least one amino acid side chain chemically modified by N-Hydroxysuccinimide (NHS), wherein the polypeptide comprises any one amino acid sequence selected from the group consisting of SEQ ID NOs: 871-887.

C44. A composition comprising a polypeptide according to any one of clauses C41-C43; and a pharmaceutically acceptable diluent.

C45. The composition according to clause C44, further comprising a sugar alcohol.

C46. The composition according to clause C44, further comprising sucrose.

C47. The composition according to clause C44, further comprising trehalose.

C48. The composition according to clause C44, further comprising a buffer.

C49. The composition according to clause C44, further comprising an adjuvant.

C50. The composition according to clause C44, further comprising aluminum hydroxide.

C51. The composition according to clause C44, further comprising a CpG oligonucleotide.

C52. The composition according to clause C44, further comprising aluminum hydroxide and a CpG oligonucleotide.

C53. An antibody or antigen binding fragment thereof comprising the amino acid sequence set forth in SEQ ID NO: 841.

C54. A method for eliciting an immune response in a human against *Clostridium difficile* expressing a toxin comprising the amino acid sequence selected from the group consisting of SEQ ID NOs: 762-840, the method comprising administering to the human two effective doses of a composition comprising a *C. difficile* toxoid.

C55. An antibody or binding fragment thereof comprising any one of the amino acid sequences set forth in SEQ ID NO: 888-1015.

C56. The antibody or binding fragment thereof of clause C55, comprising a heavy variable region having the amino acid sequence set forth in SEQ ID NO: 888 and a light chain variable region having the amino acid sequence set forth in SEQ ID NO: 889.

C57. The antibody or binding fragment thereof of clause C55, comprising a heavy variable region having the amino acid sequence set forth in SEQ ID NO: 890 and a light chain variable region having the amino acid sequence set forth in SEQ ID NO: 891.

C58. The antibody or binding fragment thereof of clause C57, wherein the antibody or binding fragment thereof binds to an epitope of *C. difficile* toxoid A, wherein the epitope comprises the amino acid sequence set forth in any one of SEQ ID NO: 1016-SEQ ID NO: 1018.

C59. The antibody or binding fragment thereof of clause C57, wherein the antibody or binding fragment thereof binds to an epitope of *C. difficile* toxin A, wherein the epitope comprises the amino acid sequence set forth in any one of SEQ ID NO: 1016-SEQ ID NO: 1018.

C60. The antibody or binding fragment thereof of clause C55, comprising a heavy variable region having the amino acid sequence set forth in SEQ ID NO: 892 and a light chain variable region having the amino acid sequence set forth in SEQ ID NO: 893.

C61. The antibody or binding fragment thereof of clause C60, wherein the antibody or binding fragment thereof binds to an epitope of *C. difficile* toxoid A, wherein the epitope comprises the amino acid sequence set forth in any one of SEQ ID NO: 1019 and SEQ ID NO: 1020.

C62. The antibody or binding fragment thereof of clause C60, wherein the antibody or binding fragment thereof binds to an epitope of *C. difficile* toxin A, wherein the epitope comprises the amino acid sequence set forth in any one of SEQ ID NO: 1019 and SEQ ID NO: 1020.

C63. The antibody or binding fragment thereof of clause C55, comprising a heavy variable region having the amino acid sequence set forth in SEQ ID NO: 894 and a light chain variable region having the amino acid sequence set forth in SEQ ID NO: 895.

C64. The antibody or binding fragment thereof of clause C63, wherein the antibody or binding fragment thereof binds to an epitope of *C. difficile* toxoid A, wherein the epitope comprises the amino acid sequence set forth in any one of SEQ ID NO: 1021 and SEQ ID NO: 1022.

C65. The antibody or binding fragment thereof of clause C60, wherein the antibody or binding fragment thereof binds to an epitope of *C. difficile* toxin A, wherein the epitope comprises the amino acid sequence set forth in any one of SEQ ID NO: 1021 and SEQ ID NO: 1022.

C66. The antibody or binding fragment thereof of clause C55, comprising a heavy variable region having the amino acid sequence set forth in SEQ ID NO: 896 and a light chain variable region having the amino acid sequence set forth in SEQ ID NO: 897.

C67. The antibody or binding fragment thereof of clause C55, comprising a heavy variable region having the amino acid sequence set forth in SEQ ID NO: 898 and a light chain variable region having the amino acid sequence set forth in SEQ ID NO: 899.

C68. The antibody or binding fragment thereof of clause C67, wherein the antibody or binding fragment thereof binds to an epitope of *C. difficile* toxoid A, wherein the epitope comprises the amino acid sequence set forth in SEQ ID NO: 1023.

C69. The antibody or binding fragment thereof of clause C67, wherein the antibody or binding fragment thereof binds to an epitope of *C. difficile* toxin A, wherein the epitope comprises the amino acid sequence set forth in SEQ ID NO: 1023.

C70. The antibody or binding fragment thereof of clause C55, comprising a heavy variable region having the amino acid sequence set forth in SEQ ID NO: 900 and a light chain variable region having the amino acid sequence set forth in SEQ ID NO: 901.

C71. The antibody or binding fragment thereof of clause C67, wherein the antibody or binding fragment thereof binds to an epitope of *C. difficile* toxoid A, wherein the epitope comprises the amino acid sequence set forth in SEQ ID NO: 1024.

C72. The antibody or binding fragment thereof of clause C67, wherein the antibody or binding fragment thereof binds to an epitope of *C. difficile* toxin A, wherein the epitope comprises the amino acid sequence set forth in SEQ ID NO: 1024.

C73. The antibody or binding fragment thereof of clause C55, comprising a heavy variable region having the amino acid sequence set forth in SEQ ID NO: 902 and a light chain variable region having the amino acid sequence set forth in SEQ ID NO: 903.

C74. The antibody or binding fragment thereof of clause C67, wherein the antibody or binding fragment thereof binds to an epitope of *C. difficile* toxoid A, wherein the epitope comprises the amino acid sequence set forth in SEQ ID NO: 1025.

C75. The antibody or binding fragment thereof of clause C67, wherein the antibody or binding fragment thereof binds to an epitope of *C. difficile* toxin A, wherein the epitope comprises the amino acid sequence set forth in SEQ ID NO: 1025.

C76. The antibody or binding fragment thereof of clause C55, comprising a heavy variable region having the amino acid sequence set forth in SEQ ID NO: 904 and a light chain variable region having the amino acid sequence set forth in SEQ ID NO: 905.

C77. The antibody or binding fragment thereof of clause C67, wherein the antibody or binding fragment thereof binds to an epitope of *C. difficile* toxoid A, wherein the epitope comprises the amino acid sequence set forth in SEQ ID NO: 1026.

C78. The antibody or binding fragment thereof of clause C67, wherein the antibody or binding fragment thereof binds to an epitope of *C. difficile* toxin A, wherein the epitope comprises the amino acid sequence set forth in SEQ ID NO: 1026.

C79. The antibody or binding fragment thereof of clause C55, comprising a heavy variable region having the amino acid sequence set forth in SEQ ID NO: 906 and a light chain variable region having the amino acid sequence set forth in SEQ ID NO: 907.

C80. The antibody or binding fragment thereof of clause C55, comprising a heavy variable region having the amino acid sequence set forth in SEQ ID NO: 908 and a light chain variable region having the amino acid sequence set forth in SEQ ID NO: 909.

C81. The antibody or binding fragment thereof of clause C80, wherein the antibody or binding fragment thereof binds to an epitope of *C. difficile* toxoid A, wherein the epitope comprises the amino acid sequence set forth in SEQ ID NO: 1027.

C82. The antibody or binding fragment thereof of clause C80, wherein the antibody or binding fragment thereof binds to an epitope of *C. difficile* toxin A, wherein the epitope comprises the amino acid sequence set forth in SEQ ID NO: 1027.

C83. The antibody or binding fragment thereof of clause C55, comprising a heavy variable region having the amino acid sequence set forth in SEQ ID NO: 910 and a light chain variable region having the amino acid sequence set forth in SEQ ID NO: 911.

C84. The antibody or binding fragment thereof of clause C83, wherein the antibody or binding fragment thereof binds to an epitope of *C. difficile* toxoid A, wherein the epitope comprises the amino acid sequence set forth in SEQ ID NO: 1028.

C85. The antibody or binding fragment thereof of clause C83, wherein the antibody or binding fragment thereof binds to an epitope of *C. difficile* toxin A, wherein the epitope comprises the amino acid sequence set forth in SEQ ID NO: 1028.

C86. The antibody or binding fragment thereof of clause C55, comprising a heavy variable region having the amino acid sequence set forth in SEQ ID NO: 912 and a light chain variable region having the amino acid sequence set forth in SEQ ID NO: 913.

C87. The antibody or binding fragment thereof of clause C86, wherein the antibody or binding fragment thereof binds to an epitope of *C. difficile* toxoid A, wherein the epitope comprises the amino acid sequence set forth in SEQ ID NO: 1029.

C88. The antibody or binding fragment thereof of clause C86, wherein the antibody or binding fragment thereof binds to an epitope of *C. difficile* toxin A, wherein the epitope comprises the amino acid sequence set forth in SEQ ID NO: 1029.

C89. The antibody or binding fragment thereof of clause C55, comprising a heavy variable region having the amino acid sequence set forth in SEQ ID NO: 914 and a light chain variable region having the amino acid sequence set forth in SEQ ID NO: 915.

C90. The antibody or binding fragment thereof of clause C89, wherein the antibody or binding fragment thereof binds to an epitope of *C. difficile* toxoid A, wherein the epitope comprises the amino acid sequence set forth in any one of SEQ ID NO: 1030 and SEQ ID NO: 1031.

C91. The antibody or binding fragment thereof of clause C89, wherein the antibody or binding fragment thereof binds to an epitope of *C. difficile* toxin A, wherein the epitope comprises the amino acid sequence set forth in any one of SEQ ID NO: 1030 and SEQ ID NO: 1031.

C92. The antibody or binding fragment thereof of clause C55, comprising a heavy variable region having the amino acid sequence set forth in SEQ ID NO: 916 and a light chain variable region having the amino acid sequence set forth in SEQ ID NO: 917.

C93. The antibody or binding fragment thereof of clause C92, wherein the antibody or binding fragment thereof binds to an epitope of *C. difficile* toxoid A, wherein the epitope comprises the amino acid sequence set forth in any one of SEQ ID NO: 1032-SEQ ID NO: 1034.

C94. The antibody or binding fragment thereof of clause C92, wherein the antibody or binding fragment thereof binds to an epitope of *C. difficile* toxin A, wherein the epitope comprises the amino acid sequence set forth in any one of SEQ ID NO: 1032-SEQ ID NO: 1034.

C95. The antibody or binding fragment thereof of clause C55, comprising a heavy variable region having the amino acid sequence set forth in SEQ ID NO: 918 and a light chain variable region having the amino acid sequence set forth in SEQ ID NO: 919.

C96. The antibody or binding fragment thereof of clause C95, wherein the antibody or binding fragment thereof binds to an epitope of *C. difficile* toxoid A, wherein the epitope comprises the amino acid sequence set forth in any one of SEQ ID NO: 1035 and SEQ ID NO: 1036.

C97. The antibody or binding fragment thereof of clause C95, wherein the antibody or binding fragment thereof binds to an epitope of *C. difficile* toxin A, wherein the epitope comprises the amino acid sequence set forth in any one of SEQ ID NO: 1035 and SEQ ID NO: 1036.

C98. The antibody or binding fragment thereof of clause C55, comprising a heavy variable region having the amino acid sequence set forth in SEQ ID NO: 920 and a light chain variable region having the amino acid sequence set forth in SEQ ID NO: 921.

C99. The antibody or binding fragment thereof of clause C98, wherein the antibody or binding fragment thereof binds to an epitope of *C. difficile* toxoid A, wherein the epitope comprises the amino acid sequence set forth in any one of SEQ ID NO: 1037 and SEQ ID NO: 1038.

C100. The antibody or binding fragment thereof of clause C98, wherein the antibody or binding fragment thereof binds to an epitope of *C. difficile* toxin A, wherein the epitope comprises the amino acid sequence set forth in any one of SEQ ID NO: 1037 and SEQ ID NO: 1038.

C101. The antibody or binding fragment thereof of clause C55, comprising a heavy variable region having the amino acid sequence set forth in SEQ ID NO: 922 and a light chain variable region having the amino acid sequence set forth in SEQ ID NO: 923.

C102. The antibody or binding fragment thereof of clause C55, comprising a heavy variable region having the amino acid sequence set forth in SEQ ID NO: 924 and a light chain variable region having the amino acid sequence set forth in SEQ ID NO: 925.

C103. The antibody or binding fragment thereof of clause C55, comprising a heavy variable region having the amino acid sequence set forth in SEQ ID NO: 926 and a light chain variable region having the amino acid sequence set forth in SEQ ID NO: 927.

C104. The antibody or binding fragment thereof of clause C55, comprising a heavy variable region having the amino acid sequence set forth in SEQ ID NO: 928 and a light chain variable region having the amino acid sequence set forth in SEQ ID NO: 929.

C105. The antibody or binding fragment thereof of clause C55, comprising a heavy variable region having the amino acid sequence set forth in SEQ ID NO: 930 and a light chain variable region having the amino acid sequence set forth in SEQ ID NO: 931.

C106. The antibody or binding fragment thereof of clause C55, comprising a heavy variable region having the amino acid sequence set forth in SEQ ID NO: 932 and a light chain variable region having the amino acid sequence set forth in SEQ ID NO: 933.

C107. The antibody or binding fragment thereof of clause C106, wherein the antibody or binding fragment thereof binds to an epitope of *C. difficile* toxoid A, wherein the epitope comprises the amino acid sequence set forth in SEQ ID NO: 1039.

C108. The antibody or binding fragment thereof of clause C106, wherein the antibody or binding fragment thereof binds to an epitope of *C. difficile* toxin A, wherein the epitope comprises the amino acid sequence set forth in SEQ ID NO: 1039.

C109. The antibody or binding fragment thereof of clause C55, comprising a heavy variable region having the amino acid sequence set forth in SEQ ID NO: 934 and a light chain variable region having the amino acid sequence set forth in SEQ ID NO: 935.

C110. The antibody or binding fragment thereof of clause C109, wherein the antibody or binding fragment thereof binds to an epitope of *C. difficile* toxoid A, wherein the epitope comprises the amino acid sequence set forth in any one of SEQ ID NO: 1040 and SEQ ID NO: 1041.

C111. The antibody or binding fragment thereof of clause C109, wherein the antibody or binding fragment thereof binds to an epitope of *C. difficile* toxin A, wherein the epitope comprises the amino acid sequence set forth in any one of SEQ ID NO: 1040 and SEQ ID NO: 1041.

C112. The antibody or binding fragment thereof of clause C55, comprising a heavy variable region having the amino acid sequence set forth in SEQ ID NO: 936 and a light chain variable region having the amino acid sequence set forth in SEQ ID NO: 937.

C113. The antibody or binding fragment thereof of clause C112, wherein the antibody or binding fragment thereof binds to an epitope of *C. difficile* toxoid A, wherein the epitope comprises the amino acid sequence set forth in any one of SEQ ID NO: 1042 and SEQ ID NO: 1043.

C114. The antibody or binding fragment thereof of clause C112, wherein the antibody or binding fragment thereof binds to an epitope of *C. difficile* toxin A, wherein the epitope comprises the amino acid sequence set forth in any one of SEQ ID NO: 1042 and SEQ ID NO: 1043.

C115. The antibody or binding fragment thereof of clause C55, comprising a heavy variable region having the amino acid sequence set forth in SEQ ID NO: 938 and a light chain variable region having the amino acid sequence set forth in SEQ ID NO: 939.

C116. The antibody or binding fragment thereof of clause C115, wherein the antibody or binding fragment thereof binds to an epitope of *C. difficile* toxoid A, wherein the epitope comprises the amino acid sequence set forth in any one of SEQ ID NO: 1044 and SEQ ID NO: 1045.

C117. The antibody or binding fragment thereof of clause C115, wherein the antibody or binding fragment thereof binds to an epitope of *C. difficile* toxin A, wherein the epitope comprises the amino acid sequence set forth in any one of SEQ ID NO: 1044 and SEQ ID NO: 1045.

C118. The antibody or binding fragment thereof of clause C55, comprising a heavy variable region having the amino acid sequence set forth in SEQ ID NO: 940 and a light chain variable region having the amino acid sequence set forth in SEQ ID NO: 941.

C119. The antibody or binding fragment thereof of clause C118, wherein the antibody or binding fragment thereof binds to an epitope of *C. difficile* toxoid A, wherein the epitope comprises the amino acid sequence set forth in any one of SEQ ID NO: 1046 and SEQ ID NO: 1047.

C120. The antibody or binding fragment thereof of clause C118, wherein the antibody or binding fragment thereof binds to an epitope of *C. difficile* toxin A, wherein the epitope comprises the amino acid sequence set forth in any one of SEQ ID NO: 1046 and SEQ ID NO: 1047.

C121. The antibody or binding fragment thereof of clause C55, comprising a heavy variable region having the amino acid sequence set forth in SEQ ID NO: 942 and a light chain variable region having the amino acid sequence set forth in SEQ ID NO: 943.

C122. The antibody or binding fragment thereof of clause C121, wherein the antibody or binding fragment thereof binds to an epitope of *C. difficile* toxoid A, wherein the epitope comprises the amino acid sequence set forth in SEQ ID NO: 1048.

C123. The antibody or binding fragment thereof of clause C121, wherein the antibody or binding fragment thereof binds to an epitope of *C. difficile* toxin A, wherein the epitope comprises the amino acid sequence set forth in SEQ ID NO: 1048.

C124. The antibody or binding fragment thereof of clause C55, comprising a heavy variable region having the amino acid sequence set forth in SEQ ID NO: 944 and a light chain variable region having the amino acid sequence set forth in SEQ ID NO: 945.

C125. The antibody or binding fragment thereof of clause C124, wherein the antibody or binding fragment thereof binds to an epitope of *C. difficile* toxoid A, wherein the epitope comprises the amino acid sequence set forth in any one of SEQ ID NO: 1049-SEQ ID NO: 1052.

C126. The antibody or binding fragment thereof of clause C124, wherein the antibody or binding fragment thereof binds to an epitope of *C. difficile* toxin A, wherein the epitope comprises the amino acid sequence set forth in any one of SEQ ID NO: 1049-SEQ ID NO: 1052.

C127. The antibody or binding fragment thereof of clause C55, comprising a heavy variable region having the amino acid sequence set forth in SEQ ID NO: 946 and a light chain variable region having the amino acid sequence set forth in SEQ ID NO: 947.

C128. The antibody or binding fragment thereof of clause C127, wherein the antibody or binding fragment thereof binds to an epitope of *C. difficile* toxoid A, wherein the epitope comprises the amino acid sequence set forth in any one of SEQ ID NO: 1053 and SEQ ID NO: 1054.

C129. The antibody or binding fragment thereof of clause C127, wherein the antibody or binding fragment thereof binds to an epitope of *C. difficile* toxin A, wherein the epitope comprises the amino acid sequence set forth in any one of SEQ ID NO: 1053 and SEQ ID NO: 1054.

C130. The antibody or binding fragment thereof of clause C55, comprising a heavy variable region having the amino acid sequence set forth in SEQ ID NO: 948 and a light chain variable region having the amino acid sequence set forth in SEQ ID NO: 949.

C131. The antibody or binding fragment thereof of clause C55, comprising a heavy variable region having the amino acid sequence set forth in SEQ ID NO: 950 and a light chain variable region having the amino acid sequence set forth in SEQ ID NO: 951.

C132. The antibody or binding fragment thereof of clause C127, wherein the antibody or binding fragment thereof binds to an epitope of *C. difficile* toxoid A, wherein the epitope comprises the amino acid sequence set forth in any one of SEQ ID NO: 1055 and SEQ ID NO: 1056.

C133. The antibody or binding fragment thereof of clause C127, wherein the antibody or binding fragment thereof binds to an epitope of *C. difficile* toxin A, wherein the epitope comprises the amino acid sequence set forth in any one of SEQ ID NO: 1055 and SEQ ID NO: 1056.

C134. The antibody or binding fragment thereof of clause C55, comprising a heavy variable region having the amino acid sequence set forth in SEQ ID NO: 952 and a light chain variable region having the amino acid sequence set forth in SEQ ID NO: 953.

C135. The antibody or binding fragment thereof of clause C134, wherein the antibody or binding fragment thereof binds to an epitope of *C. difficile* toxoid A, wherein the epitope comprises the amino acid sequence set forth in any one of SEQ ID NO: 1057 and SEQ ID NO: 1058.

C136. The antibody or binding fragment thereof of clause C134, wherein the antibody or binding fragment thereof binds to an epitope of *C. difficile* toxin A, wherein the epitope comprises the amino acid sequence set forth in any one of SEQ ID NO: 1057 and SEQ ID NO: 1058.

C137. The antibody or binding fragment thereof of clause C55, comprising a heavy variable region having the amino acid sequence set forth in SEQ ID NO: 954 and a light chain variable region having the amino acid sequence set forth in SEQ ID NO: 955.

C138. The antibody or binding fragment thereof of clause C137, wherein the antibody or binding fragment thereof binds to an epitope of *C. difficile* toxoid A, wherein the epitope comprises the amino acid sequence set forth in SEQ ID NO: 1059.

C139. The antibody or binding fragment thereof of clause C137, wherein the antibody or binding fragment thereof binds to an epitope of *C. difficile* toxin A, wherein the epitope comprises the amino acid sequence set forth in SEQ ID NO: 1059.

C140. The antibody or binding fragment thereof of clause C55, comprising a heavy variable region having the amino acid sequence set forth in SEQ ID NO: 956 and a light chain variable region having the amino acid sequence set forth in SEQ ID NO: 957.

C141. The antibody or binding fragment thereof of clause C140, wherein the antibody or binding fragment thereof binds to an epitope of *C. difficile* toxoid A, wherein the epitope comprises the amino acid sequence set forth in SEQ ID NO: 1060.

C142. The antibody or binding fragment thereof of clause C140, wherein the antibody or binding fragment thereof binds to an epitope of *C. difficile* toxin A, wherein the epitope comprises the amino acid sequence set forth in SEQ ID NO: 1060.

C143. The antibody or binding fragment thereof of clause C55, comprising a heavy variable region having the amino acid sequence set forth in SEQ ID NO: 958 and a light chain variable region having the amino acid sequence set forth in SEQ ID NO: 959.

C144. The antibody or binding fragment thereof of clause C143, wherein the antibody or binding fragment thereof binds to an epitope of *C. difficile* toxoid A, wherein the epitope comprises the amino acid sequence set forth in SEQ ID NO: 1061.

C145. The antibody or binding fragment thereof of clause C143, wherein the antibody or binding fragment thereof binds to an epitope of *C. difficile* toxin A, wherein the epitope comprises the amino acid sequence set forth in SEQ ID NO: 1061.

C146. The antibody or binding fragment thereof of clause C55, comprising a heavy variable region having the amino acid sequence set forth in SEQ ID NO: 960 and a light chain variable region having the amino acid sequence set forth in SEQ ID NO: 961.

C147. The antibody or binding fragment thereof of clause C146, wherein the antibody or binding fragment thereof binds to an epitope of *C. difficile* toxoid A, wherein the epitope comprises the amino acid sequence set forth in SEQ ID NO: 1062.

C148. The antibody or binding fragment thereof of clause C146, wherein the antibody or binding fragment thereof binds to an epitope of *C. difficile* toxin A, wherein the epitope comprises the amino acid sequence set forth in SEQ ID NO: 1062.

C149. The antibody or binding fragment thereof of clause C55, comprising a heavy variable region having the amino acid sequence set forth in SEQ ID NO: 962 and a light chain variable region having the amino acid sequence set forth in SEQ ID NO: 963.

C150. The antibody or binding fragment thereof of clause C149, wherein the antibody or binding fragment thereof binds to an epitope of *C. difficile* toxoid A, wherein the epitope comprises the amino acid sequence set forth in any one of SEQ ID NO: 1063 and SEQ ID NO: 1064.

C151. The antibody or binding fragment thereof of clause C149, wherein the antibody or binding fragment thereof binds to an epitope of *C. difficile* toxin A, wherein the epitope comprises the amino acid sequence set forth in any one of SEQ ID NO: 1063 and SEQ ID NO: 1064.

C152. The antibody or binding fragment thereof of clause C55, comprising a heavy variable region having the amino acid sequence set forth in SEQ ID NO: 964 and a light chain variable region having the amino acid sequence set forth in SEQ ID NO: 965.

C153. The antibody or binding fragment thereof of clause C152, wherein the antibody or binding fragment thereof binds to an epitope of *C. difficile* toxoid A, wherein the epitope comprises the amino acid sequence set forth in any one of SEQ ID NO: 1065 and SEQ ID NO: 1066.

C154. The antibody or binding fragment thereof of clause C152, wherein the antibody or binding fragment thereof binds to an epitope of *C. difficile* toxin A, wherein the epitope comprises the amino acid sequence set forth in any one of SEQ ID NO: 1065 and SEQ ID NO: 1066.

C155. The antibody or binding fragment thereof of clause C55, comprising a heavy variable region having the amino acid sequence set forth in SEQ ID NO: 966 and a light chain variable region having the amino acid sequence set forth in SEQ ID NO: 967.

C156. The antibody or binding fragment thereof of clause C55, comprising a heavy variable region having the amino acid sequence set forth in SEQ ID NO: 968 and a light chain variable region having the amino acid sequence set forth in SEQ ID NO: 969.

C157. The antibody or binding fragment thereof of clause C55, comprising a heavy variable region having the amino acid sequence set forth in SEQ ID NO: 970 and a light chain variable region having the amino acid sequence set forth in SEQ ID NO: 971.

C158. The antibody or binding fragment thereof of clause C157, wherein the antibody or binding fragment thereof binds to an epitope of *C. difficile* toxoid A, wherein the epitope comprises the amino acid sequence set forth in any one of SEQ ID NO: 1067 and SEQ ID NO: 1068.

C159. The antibody or binding fragment thereof of clause C157, wherein the antibody or binding fragment thereof binds to an epitope of *C. difficile* toxin A, wherein the epitope comprises the amino acid sequence set forth in any one of SEQ ID NO: 1067 and SEQ ID NO: 1068.

C160. The antibody or binding fragment thereof of clause C55, comprising a heavy variable region having the amino acid sequence set forth in SEQ ID NO: 972 and a light chain variable region having the amino acid sequence set forth in SEQ ID NO: 973.

C161. The antibody or binding fragment thereof of clause C160, wherein the antibody or binding fragment thereof binds to an epitope of *C. difficile* toxoid A, wherein the epitope comprises the amino acid sequence set forth in any one of SEQ ID NO: 1069 and SEQ ID NO: 1070.

C162. The antibody or binding fragment thereof of clause C160, wherein the antibody or binding fragment thereof binds to an epitope of *C. difficile* toxin A, wherein the epitope comprises the amino acid sequence set forth in any one of SEQ ID NO: 1069 and SEQ ID NO: 1070.

C163. The antibody or binding fragment thereof of clause C55, comprising a heavy variable region having the amino acid sequence set forth in SEQ ID NO: 974 and a light chain variable region having the amino acid sequence set forth in SEQ ID NO: 975.

C164. The antibody or binding fragment thereof of clause C164, wherein the antibody or binding fragment thereof binds to an epitope of *C. difficile* toxoid A, wherein the epitope comprises the amino acid sequence set forth in any one of SEQ ID NO: 1071 and SEQ ID NO: 1072.

C165. The antibody or binding fragment thereof of clause C164, wherein the antibody or binding fragment thereof binds to an epitope of *C. difficile* toxin A, wherein the epitope comprises the amino acid sequence set forth in any one of SEQ ID NO: 1071 and SEQ ID NO: 1072.

C166. The antibody or binding fragment thereof of clause C55, comprising a heavy variable region having the amino acid sequence set forth in SEQ ID NO: 976 and a light chain variable region having the amino acid sequence set forth in SEQ ID NO: 977.

C167. The antibody or binding fragment thereof of clause C166, wherein the antibody or binding fragment thereof binds to an epitope of *C. difficile* toxoid A, wherein the epitope comprises the amino acid sequence set forth in any one of SEQ ID NO: 1071 and SEQ ID NO: 1072.

C168. The antibody or binding fragment thereof of clause C166, wherein the antibody or binding fragment thereof binds to an epitope of *C. difficile* toxin A, wherein the epitope comprises the amino acid sequence set forth in any one of SEQ ID NO: 1071 and SEQ ID NO: 1072.

C169. The antibody or binding fragment thereof of clause C55, comprising a heavy variable region having the amino acid sequence set forth in SEQ ID NO: 978 and a light chain variable region having the amino acid sequence set forth in SEQ ID NO: 979.

C170. The antibody or binding fragment thereof of clause C169, wherein the antibody or binding fragment thereof binds to an epitope of *C. difficile* toxoid A, wherein the epitope comprises the amino acid sequence set forth in any one of SEQ ID NO: 1073 and SEQ ID NO: 1074.

C171. The antibody or binding fragment thereof of clause C169, wherein the antibody or binding fragment thereof binds to an epitope of *C. difficile* toxin A, wherein the epitope comprises the amino acid sequence set forth in any one of SEQ ID NO: 1073 and SEQ ID NO: 1074.

C172. The antibody or binding fragment thereof of clause C55, comprising a heavy variable region having the amino acid sequence set forth in SEQ ID NO: 980 and a light chain variable region having the amino acid sequence set forth in SEQ ID NO: 981.

C173. The antibody or binding fragment thereof of clause C55, comprising a heavy variable region having the amino acid sequence set forth in SEQ ID NO: 982 and a light chain variable region having the amino acid sequence set forth in SEQ ID NO: 983.

C174. The antibody or binding fragment thereof of clause C173, wherein the antibody or binding fragment thereof binds to an epitope of *C. difficile* toxoid A, wherein the epitope comprises the amino acid sequence set forth in any one of SEQ ID NO: 1075 and SEQ ID NO: 1076.

C175. The antibody or binding fragment thereof of clause C173, wherein the antibody or binding fragment thereof binds to an epitope of *C. difficile* toxin A, wherein the epitope comprises the amino acid sequence set forth in any one of SEQ ID NO: 1073 and SEQ ID NO: 1074.

C176. The antibody or binding fragment thereof of clause C55, comprising a heavy variable region having the amino acid sequence set forth in SEQ ID NO: 984 and a light chain variable region having the amino acid sequence set forth in SEQ ID NO: 985.

C177. The antibody or binding fragment thereof of clause C55, comprising a heavy variable region having the amino acid sequence set forth in SEQ ID NO: 986 and a light chain variable region having the amino acid sequence set forth in SEQ ID NO: 987.

C178. The antibody or binding fragment thereof of clause C177, wherein the antibody or binding fragment thereof binds to an epitope of *C. difficile* toxoid A, wherein the epitope comprises the amino acid sequence set forth in any one of SEQ ID NO: 1077 and SEQ ID NO: 1078.

C179. The antibody or binding fragment thereof of clause C177, wherein the antibody or binding fragment thereof binds to an epitope of *C. difficile* toxin A, wherein the epitope comprises the amino acid sequence set forth in any one of SEQ ID NO: 1077 and SEQ ID NO: 1078.

C180. The antibody or binding fragment thereof of clause C55, comprising a heavy variable region having the amino acid sequence set forth in SEQ ID NO: 988 and a light chain variable region having the amino acid sequence set forth in SEQ ID NO: 989.

C181. The antibody or binding fragment thereof of clause C55, comprising a heavy variable region having the amino acid sequence set forth in SEQ ID NO: 990 and a light chain variable region having the amino acid sequence set forth in SEQ ID NO: 991.

C182. The antibody or binding fragment thereof of clause C55, comprising a heavy variable region having the amino acid sequence set forth in SEQ ID NO: 992 and a light chain variable region having the amino acid sequence set forth in SEQ ID NO: 993.

C183. The antibody or binding fragment thereof of clause C55, comprising a heavy variable region having the amino acid sequence set forth in SEQ ID NO: 994 and a light chain variable region having the amino acid sequence set forth in SEQ ID NO: 995.

C184. The antibody or binding fragment thereof of clause C183, wherein the antibody or binding fragment thereof binds to an epitope of *C. difficile* toxoid A, wherein the epitope comprises the amino acid sequence set forth in any one of SEQ ID NO: 1079 and SEQ ID NO: 1080.

C185. The antibody or binding fragment thereof of clause C183, wherein the antibody or binding fragment thereof binds to an epitope of *C. difficile* toxin A, wherein the epitope comprises the amino acid sequence set forth in any one of SEQ ID NO: 1079 and SEQ ID NO: 1080.

C186. The antibody or binding fragment thereof of clause C55, comprising a heavy variable region having the amino acid sequence set forth in SEQ ID NO: 996 and a light chain variable region having the amino acid sequence set forth in SEQ ID NO: 997.

C187. The antibody or binding fragment thereof of clause C186, wherein the antibody or binding fragment thereof binds to an epitope of *C. difficile* toxoid A, wherein the epitope comprises the amino acid sequence set forth in any one of SEQ ID NO: 1081-SEQ ID NO: 1083.

C188. The antibody or binding fragment thereof of clause C186, wherein the antibody or binding fragment thereof binds to an epitope of *C. difficile* toxin A, wherein the epitope comprises the amino acid sequence set forth in any one of SEQ ID NO: 1081-SEQ ID NO: 1083.

C189. The antibody or binding fragment thereof of clause C55, comprising a heavy variable region having the amino acid sequence set forth in SEQ ID NO: 998 and a light chain variable region having the amino acid sequence set forth in SEQ ID NO: 999.

C190. The antibody or binding fragment thereof of clause C55, comprising a heavy variable region having the amino acid sequence set forth in SEQ ID NO: 1000 and a light chain variable region having the amino acid sequence set forth in SEQ ID NO: 1001.

C191. The antibody or binding fragment thereof of clause C190, wherein the antibody or binding fragment thereof binds to an epitope of *C. difficile* toxoid A, wherein the epitope comprises the amino acid sequence set forth in SEQ ID NO: 1084.

C192. The antibody or binding fragment thereof of clause C190, wherein the antibody or binding fragment thereof binds to an epitope of *C. difficile* toxin A, wherein the epitope comprises the amino acid sequence set forth in SEQ ID NO: 1084.

C193. The antibody or binding fragment thereof of clause C55, comprising a heavy variable region having the amino acid sequence set forth in SEQ ID NO: 1002 and a light chain variable region having the amino acid sequence set forth in SEQ ID NO: 1003.

C194. The antibody or binding fragment thereof of clause C193, wherein the antibody or binding fragment thereof binds to an epitope of *C. difficile* toxoid A, wherein the epitope comprises the amino acid sequence set forth in any one of SEQ ID NO: 1085-SEQ ID NO: 1088.

C195. The antibody or binding fragment thereof of clause C193, wherein the antibody or binding fragment thereof binds to an epitope of *C. difficile* toxin A, wherein the epitope comprises the amino acid sequence set forth in any one of SEQ ID NO: 1085-SEQ ID NO: 1088.

C196. The antibody or binding fragment thereof of clause C55, comprising a heavy variable region having the amino acid sequence set forth in SEQ ID NO: 1004 and a light chain variable region having the amino acid sequence set forth in SEQ ID NO: 1005.

C197. The antibody or binding fragment thereof of clause C196, wherein the antibody or binding fragment thereof binds to an epitope of *C. difficile* toxoid A, wherein the epitope comprises the amino acid sequence set forth in any one of SEQ ID NO: 1088-SEQ ID NO: 1090.

C198. The antibody or binding fragment thereof of clause C196, wherein the antibody or binding fragment thereof binds to an epitope of *C. difficile* toxin A, wherein the epitope comprises the amino acid sequence set forth in any one of SEQ ID NO: 1088-SEQ ID NO: 1090.

C199. The antibody or binding fragment thereof of clause C55, comprising a heavy variable region having the amino acid sequence set forth in SEQ ID NO: 1006 and a light chain variable region having the amino acid sequence set forth in SEQ ID NO: 1007.

C200. The antibody or binding fragment thereof of clause C55, comprising a heavy variable region having the amino acid sequence set forth in SEQ ID NO: 1008 and a light chain variable region having the amino acid sequence set forth in SEQ ID NO: 1009.

C201. The antibody or binding fragment thereof of clause C55, comprising a heavy variable region having the amino acid sequence set forth in SEQ ID NO: 1010 and a light chain variable region having the amino acid sequence set forth in SEQ ID NO: 1011.

C202. The antibody or binding fragment thereof of clause C55, comprising a heavy variable region having the amino acid sequence set forth in SEQ ID NO: 1012 and a light chain variable region having the amino acid sequence set forth in SEQ ID NO: 1013.

C203. The antibody or binding fragment thereof of clause C55, comprising a heavy variable region having the amino acid sequence set forth in SEQ ID NO: 1014 and a light chain variable region having the amino acid sequence set forth in SEQ ID NO: 1015.

C204. The antibody or binding fragment thereof of clause C55, wherein the antibody or binding fragment thereof binds to an epitope of *C. difficile* toxin A, wherein the epitope comprises the amino acid sequence set forth in any one of SEQ ID NO: 1016-SEQ ID NO: 1090.

C205. The antibody or binding fragment thereof of any one of clause C201-C203, wherein the antibody or binding fragment thereof binds to an epitope of *C. difficile* toxin B.

C206. The antibody or binding fragment thereof of clause C55, wherein the antibody or binding fragment thereof has a Kd for *C. difficile* toxin of 0.01 to 277.

C207. A method of detecting the presence of a *C. difficile* toxin A or fragment thereof in a sample comprising contacting said sample with an antibody or binding fragment thereof that binds to *C. difficile* toxin A wherein the antibody or binding fragment thereof comprises the antibody or binding fragment thereof according to any one of clauses C56-C200.

C208. The method of clause C207, wherein the method of detecting is selected from a pull-down assay, dot blot assay, PCR assay or sandwich assay.

C209. The method of clause C207, wherein the method of detecting provides a quantitative measure of *C. difficile* toxin A.

C210. A method of detecting the presence of a *C. difficile* toxoid A or fragment thereof in a sample comprising contacting said sample with an antibody or binding fragment thereof that binds to *C. difficile* toxin A wherein the antibody or binding fragment thereof comprises the antibody or binding fragment thereof according to any one of clauses C56-C200.

C211. A method of detecting the presence of a *C. difficile* toxin A or fragment thereof in a sample comprising contacting said sample with an antibody or binding fragment thereof that binds to *C. difficile* toxin A wherein the antibody or binding fragment thereof comprises the antibody or binding fragment thereof according to any one of clauses C56-C200.

C212. A method of detecting the presence of a *C. difficile* toxin A or fragment thereof in a sample comprising contacting said sample with an antibody or binding fragment thereof that binds to *C. difficile* toxin A wherein the antibody or binding fragment thereof comprises the antibody or binding fragment thereof according to any one of clauses C56-C200.

C213. The method of clause C207, wherein the method of detecting is selected from a pull-down assay, dot blot assay, PCR assay or sandwich assay.

C214. The method of clause C207, wherein the method of detecting provides a quantitative measure of *C. difficile* toxin A.

C215. A method of detecting the presence of a *C. difficile* toxoid A or fragment thereof in a sample comprising contacting said sample with an antibody or binding fragment thereof that binds to *C. difficile* toxin A wherein the antibody or binding fragment thereof comprises the antibody or binding fragment thereof according to any one of clauses C56-C200.

C216. A method of detecting the presence of a *C. difficile* toxin A or fragment thereof in a sample comprising contacting said sample with an antibody or binding fragment thereof that binds to *C. difficile* toxin A wherein the antibody or binding fragment thereof comprises the antibody or binding fragment thereof according to any one of clauses C56-C200.

C217. A method of treating *C. difficile* disease in a subject, the method comprising administering to the subject an antibody that binds to *C. difficile* toxin A, or an antigen binding portion thereof, wherein the antibody binds to the same epitope of *C. difficile* toxin A recognized by the antibody or binding fragment thereof according to any one of clauses C56-C200, wherein *C. difficile* disease is treated in the subject.

C218. A method of detecting the presence of a *C. difficile* toxin B or fragment thereof in a sample comprising contacting said sample with an antibody or binding fragment thereof that binds to *C. difficile* toxin B wherein the antibody or binding fragment thereof comprises the antibody or binding fragment thereof according to any one of clauses C201-C203.

C219. The method of clause C218, wherein the method of detecting is selected from a pull-down assay, dot blot assay, PCR assay or sandwich assay.

C220. The method of clause C218, wherein the method of detecting provides a quantitative measure of *C. difficile* toxin B.

C221. A method of detecting the presence of a *C. difficile* toxoid B or fragment thereof in a sample comprising contacting said sample with an antibody or binding fragment thereof that binds to *C. difficile* toxin B wherein the antibody or binding fragment thereof comprises the antibody or binding fragment thereof according to any one of clauses C201-C203.

C222. A method of detecting the presence of a *C. difficile* toxin B or fragment thereof comprising contacting said sample with an antibody or binding fragment thereof that binds to *C. difficile* toxin B wherein the antibody or binding fragment thereof comprises the antibody or binding fragment thereof according to any one of clauses C201-C203.

C223. A method of detecting the presence of a *C. difficile* toxin B or fragment thereof in a sample comprising contacting said sample with an antibody or binding fragment thereof that binds to *C. difficile* toxin B wherein the antibody or binding fragment thereof comprises the antibody or binding fragment thereof according to any one of clauses C201-C203.

C224. The method of clause C223, wherein the method of detecting is selected from a pull-down assay, dot blot assay, PCR assay or sandwich assay.

C225. The method of clause C223, wherein the method of detecting provides a quantitative measure of *C. difficile* toxin B.

C226. A method of detecting the presence of a *C. difficile* toxoid B or fragment thereof in a sample comprising contacting said sample with an antibody or binding fragment thereof that binds to *C. difficile* toxin B wherein the antibody or binding fragment thereof comprises the antibody or binding fragment thereof according to any one of clauses C201-C203.

C227. A method of detecting the presence of a *C. difficile* toxin B or fragment thereof in a sample comprising contacting said sample with an antibody or binding fragment thereof that binds to *C. difficile* toxin B wherein the antibody or binding fragment thereof comprises the antibody or binding fragment thereof according to any one of clauses C201-C203.

C228. A method of treating *C. difficile* disease in a subject, the method comprising administering to the subject an antibody that binds to *C. difficile* toxin B, or an antigen binding portion thereof, wherein the antibody binds to the same epitope of *C. difficile* toxin B recognized by the antibody or binding fragment thereof according to any one of clauses C201-C203, wherein *C. difficile* disease is treated in the subject.

C229. A composition comprising an immunogenic amount of a mutant *Clostridioides difficile* toxin; and QS-21.

C230. A method of eliciting an immune response in a human, comprising administering to the human at least two doses of a mutant *Clostridioides difficile* toxin, wherein the immune response is maintained at least 12 months after the last dose.

---

SEQUENCE LISTING (1090 sequences)

SEQ ID NO: 1 - protein, 2709 aa, Clostridium difficile
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 2 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 3 - protein, 2710 aa, Artificial
  Synthetic amino acid sequence: TcdA (D285A D287A mutations)
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 4 - protein, 2710 aa, Artificial
  Synthetic amino acid sequence: TcdA (D285A D287A C700A mutations)
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 5 - protein, 2366 aa, Artificial
  Synthetic amino acid sequence: TcdB (D286A D288A mutations)
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 6 - protein, 2366 aa, Artificial
  Synthetic amino acid sequence: TcdB (D286A D288A C698A mutations)
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 7 - protein, 2710 aa, Artificial
  Synthetic amino acid sequence: TcdA (D269A, R272A, D285A, D287A, E460A, R462A, and C700A mutations)
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASAIVALLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPAAASTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 8 - protein, 2366 aa, Artificial
  Synthetic amino acid sequence: TcdB (D270A, R273A, D286A, D288A, D461A, K463A, and C698A mutations)
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPAVATTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 9 - DNA, 8133 bp, Clostridium difficile
atgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagatgttgatatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggtgattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatattattgagaaaatcaatactttaggcctagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccctgggatatatggctaa

SEQ ID NO: 10 - DNA, 7101 bp, Clostridium difficile
atgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagatgttgatatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggcagtatgaatatccatttgatagaagctgatttaagaaactttgaaatctctaaaactaatatttctcaatcaactgaacaagaaatggctagcttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttacagctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 11 - DNA, 8133 bp, Artificial
  Synthetic nucleotide sequence: TcdA gene (D285A D287A mutations)
atgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagcagttgcaatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggtgattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatattattgagaaaatcaatactttaggactagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagcaggtggacttttcgagattgatggtgttatatatttctttggtgttgatggagtaaaagcccctgggatatatggctaa

SEQ ID NO: 12 - DNA, 8133 bp, Artificial
  Synthetic nucleotide sequence: TcdA gene (D285A D287A  C700A mutations)
atgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagcagttgcaatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggagctaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggtgattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatattattgagaaaatcaatactttaggactagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagcaggtggacttttcgagattgatggtgttatatatttctttggtgttgatggagtaaaagcccctgggatatatggctaa

SEQ ID NO: 13 - DNA, 7101 bp, Artificial
  Synthetic nucleotide sequence: TcdB (D286A D288A mutations)
atgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagcagttgcaatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcttatgcggcagcttatcaagatttattaatgtttaaagaaggcagtatgaatatccatttgatagaagctgatttaagaaactttgaaatctctaaaactaatatttctcaatcaactgaacaagaaatggcttctttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttactgctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 14 - DNA, 7101 bp, Artificial
  Synthetic nucleotide sequence: TcdB (D286A D288A C698A mutations)
atgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagcagttgcaatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcttatgcggcagcttatcaagatttattaatgtttaaagaaggcagtatgaatatccatttgatagaagctgatttaagaaactttgaaatctctaaaactaatatttctcaatcaactgaacaagaaatggcttctttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggagctaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttactgctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 15 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENNGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 16 - DNA, 8133 bp, Clostridium difficile
atgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaaattcaagcagaaatagagcactctctaatctaaaaaaagatatattaaaagaagtaattcttattaaaaattccaatacaagtcctgtagaaaaaaatttacattttgtatggataggtggagaagtcagtgatattgctcttgaatacataaaacaatgggctgatattaatgcagaatataatattaaactgtggtatgatagtgaagcattcttagtcaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactttattagaatcatatagaacaaattctttgagaaaaataaatagtaatcatgggatagatatcagggctaatagtttgtttacagaacaagagttattaaatatttatagtcaggagttgttaaatcgtgggaatttagctgcagcatctgacatagtaagattattagccctaaaaaattttggcggagtatatttagatgttgatatgcttccaggtattcactctgatttatttaaaacaatacctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgacaataacttcacagatactactaagatttttcatgattcactatttaattcagctaccgcagaaaactctatgtttttaacaaaaatagcaccatacttacaagtaggttttatgccagaagctcgctccacaataagtttaagtggtccaggagcttatgcatcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagttactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttgcttggatgtaatatgtttagttatgattttaatgttgaagaaacttatcctggtaagttactattaagtattatggacaaaattacttccactttacctgatgtaaataaagattctattactataggagcaaatcaatatgaagtaagaattaatagtgagggaagaaaagaacttctagctcactcaggtaaatggataaataaagaggaagctattatgagcgatttatctagtaaagaatacattttttttgattccatagataataagctaaaagcaaagtccaagaatattccaggtttagcgtcaatatcagaagatataaaaacattattacttgatgcaagtgttagtcctgatacaaaatttattttaaataatcttaagcttaatattgaatcttctattggtgattacatttattatgaaaaattagaacctgttaaaaatataatccacaattctatagatgatttaatagatgagttcaatctacttgaaaatgtatctgatgaattatatgaattaaaaaaattaaataatctagatgagaagtatttaatatcttttgaagatatctcaaaaaataattcaacttattctgtaagatttattaacaaaagtaatggtgaatcagtttatgtagagacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaactagaagctaaggtgggtgttttagcaataaatatgtcattatctatagctgcaacggtagcttcaattgttggaataggtgctgaagttactattttcttattacctatagctggtatatctgcgggaataccttcattagttaataatgaattaatattgcatgataaggcaacttcagtggtaaactattttaatcatttgtctgaatctaaagaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatatataagctctcatattccttcattatcagtttattctgcaataggtataaaaacagaaaatctagatttttcaaaaaaaataatgatgttaccaaatgctccttcaagagtgttttggtgggaaactggagcagttccaggtttaagatcattggaaaataatgggactaaattgcttgattcaataagagatttatacccaggcaaattttactggagattctatgcctttttcgattatgcaataactacattaaaaccagtgtatgaagacactaatactaaaattaaactagataaagatactagaaactttataatgccaactataactactgacgaaattagaaacaaattatcttattcatttgatggagcaggaggaacttactctttattattatcttcatatccaatatcaatgaatataaatttatctaaagatgatttatggatatttaatattgataatgaagtaagagaaatatctatagaaaatggtactattaaaaaaggaaatttaatagaagatgttttaagtaaaattgatataaataaaaataaacttattataggcaatcaaacaatagatttttcaggtgatatagataacaaagatagatatatattcttgacttgtgagttagatgataaaattagtttaataatagaaataaatcttgttgcaaaatcttatagtttgttattgtctggggataaaaattatttgatatccaatttatctaatactattgagaaaatcaatactttaggcctagatagtaaaaatatagcttacaattacactgatgaatctaataataaatattttggagctatatctaaaacaagtcaaaaaagcataatacattataaaaaagacagtaaaaatatattagaattttataatggcagtacattagaatttaacagtaaagactttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttgaacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatctaacttagtaactggatggcaaactatcaatggtaaaaaatattattttgatataaatactggagcagcttcaactagttataaaattattaatggtaaacacttttattttaataataatggtgtgatgcagttaggagtatttaaaggacctgatggatttgagtattttgcacctgccaatactcagaataataacatagaaggtcaggctatagtttatcaaagtaaattcttaactttgaatggcaaaaaatattattttgataatgactcaaaagcagtcactggatggaggattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtggctctaatggatttgaatatttcgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaagtattactttaatactaacactgctgaagcagctactggatggcaaactattgatggtaaaaaatattactttaatactaacacttctatagcttcaactggttatacaattattaatggtaaatatttttattttaatactgatggtattatgcagataggagtgtttaaagtacctaatggatttgaatactttgcacctgctaatactcataataataacatagaaggtcaagctatactttaccaaaataaattcttaactttgaatggtaaaaaatattactttggtagtgactcaaaagcaattactggatggcaaaccattgatggtaaaaaatattactttaatcctaataatgctattgctgcgactcatctatgcactataaataacgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcataataataacatagaaggtcaggctatagtttaccagaataaattcttaactttgaatggcaaaaaatattattttgataatgactcaaaagcagttactggatggcaaactattgatagtaaaaaatattactttaatcttaacactgctgttgcagttactggatggcaaactattgatggtgaaaaatattactttaatcttaacactgctgaagcagctactggatggcaaactattgatggtaaaagatactactttaatactaacacttatatagcttcaactggttatacgattattaatggtaaacatttttattttaatactgatggtattatgcagataggagtgtttaaaggacctgatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttatatagcttcaactggttatacaattattagtggtaaacatttttattttaatactgatggtattatgcagataggagtgtttaaaggacctgatggatttgaatactttgcacctgctaatacggatgctaacaacatagaaggtcaagctatacgttatcaaaatagattcctatatttacatgacaatatatattactttggcaatgattcaaaagcggctactggttgggcaactattgatggtaatagatattacttcgagcctaatacagctatgggtgcgaatggttataaaactattgataataaaaatttttactttagaaatggtttacctcagataggagtgtttaaaggacctaatggatttgaatactttgcacctgctaatacggatgctaacaatatagatggtcaagctatacgttatcaaaatagattcctacatttacttggaaaaatatattactttggtaataactcaaaagcagttactggatggcaaactattaatagtaaagtatattactttatgcctgatactgctatggctgcagctggtggacttttcgagattgatggtgttatatatttctttggtgttgatggagtaaaagcccctgggatatatggctaa

SEQ ID NO: 17 - protein, 2710 aa, Clostridium difficile; identical to SEQ ID NO: 15

SEQ ID NO: 18 - DNA, 8133 bp, Clostridium difficile; identical to SEQ ID NO: 16

SEQ ID NO: 19 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 20 - DNA, 8133 bp, Clostridium difficile
atgtctttaatatctaaagaagagttaataaaactcgcatatagcattagaccaagagaaaatgagtataaaactatactaactaatttagacgaatataataagttaactacaaacaataatgaaaataaatatttgcaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagatgttgatatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggggattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatactattgagaaaatcaatactttaggcctagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatataaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaactagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataataactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggattgcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatacggatgctaacaacatagaaggtcaagctatactttaccaaaataaattcttaactttgaatggtaaaaaatattactttggtagtgactcaaaagcagttaccggactgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcggctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccctgggatatatggctaa

SEQ ID NO: 21 - protein, 2366 aa, Clostridium difficile
MSLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVDMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEGRIEEAKSLTSDSINYIKNEFKLIESISDALYDLKQQNELEESHFISFEDILETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 22 - DNA, 7101 bp, Clostridium difficile
atgagtttagttaatagaaaacagttagaaaaaatggcaaatgtaagatttcgtgttcaggaagatgaatatgtagcaatattggatgctttagaagaatatcataatatgtcagagaatactgtagtcgaaaaatatttaaaattaaaagatataaatagtttaacagatatttatatagatacatataaaaagtctggtagaaataaagccttaaaaaaatttaaggaatacctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactatagtagaatcagcaacaaatgatacacttgaatcatttagagaaaacttaaatgaccctagatttgactataataaattttacagaaaacgtatggagataatctatgataagcagaaaaatttcataaattactataaaactcaaagagaagaaaatcctgaccttataattgatgatattgtaaagatatatctttcaaacgagtattcaaaggatatagatgaacttaattcctatattgaagagtcattaaataaagttacagaaaatagtgggaatgatgttagaaactttgaagaatttaaaggtggagagtcattcaaattatatgaacaagagttggtagaaagatggaatttggcagctgcttctgacatattaagaatatctgccttaaaagaagttggtggtgtatatttagatgttgatatgttaccaggaatacaaccagacctatttgagtctatagagaaacctagttcagtaacagtggatttttgggaaatggtaaaattagaagctataatgaaatacaaagaatacataccaggatatacttcagagcattttgatatgttggatgaagaagttcaaagtagttttgaatctgttctagcttctaagtcagataagtcagaaatattctcatcacttggcgatatggaggcatcaccactagaagttaaaattgcatttaatagtaaaggtattataaatcaaggactaatttctgtgaaagactcatattgtagcaatttaatagtaaaacaaatcgagaacagatataagatattgaataatagtttaaatccagctattagcgaggataacgatttcaatactacaacgaatgcttttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggtagtatgaatatccatttgatagaagctgacttaagaaactttgaaatctctaaaactaatatttctcaatcaactgaacaagaaatggctagcttatggtcatttgacgatgcaagagctaaagctcaatttgaagaatacaaaaaaaattactttgaaggttctcttggagaagatgacaatcttgacttttctcaaaatacagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggtcttgatgtagattcattatccacagaaatagaaacagcaatagatttagctaaagaggatatttctcctaagtcaatagaaataaacttactgggatgtaacatgtttagctattctgtaaatgtagaggagacttatcctgggaaattattacttagagttaaagataaagtatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattatagtaaaatctaaaaatttacctgaattatctacattattacaagaaattagaaacaattctaattcaagtgatattgaactagaagaaaaagtaatgttagcagaatgtgagataaatgttatttcaaatatagatacacaagtggtagaaggaaggattgaagaagctaaaagcttaacttctgactctattaattatataaagaatgaatttaaactaatagaatctatttctgatgcactatacgatttaaaacaacagaatgaattagaagagtctcattttatatcttttgaggatatattggagactgatgaaggctttagtataagatttattgataaagaaactggagaatctatatttgtagaaactgaaaaggcaatattctctgaatatgctaatcatataactgaagagatttctaagataaaaggtactatatttgatactgtaaatggtaagttagtaaaaaaagtaaatttagatgctacacatgaagtgaatactttaaatgctgcattttttatacaatcattaatagaatataatagttctaaagaatctcttagtaatttaagtgtagcaatgaaagttcaagtttatgctcaattatttagtactggtttaaatactattacagatgcagccaaagttgttgaattagtatcaactgcattagatgaaactatagatttacttcctacattatctgaaggattacctgtaattgcaactatcatagatggtgtaagtttaggtgcagcaatcaaagagctaagtgaaacaagtgacccattattaagacaagaaatagaagctaagataggtataatggcagtaaatttaacagcagctacaactgcaatcattacttcatctttaggaatagctagtggatttagtatacttttagttcctttagcaggaatttcagcaggtataccaagtttagtaaacaatgagcttatcctaagagataaagcaacaaaagttgtagattattttagtcatatatcattagctgagtctgaaggagcatttacttcattagatgataaaataatgatgccacaagatgatttagtaatatctgagatagactttaataacaattcaataactttaggtaaatgtgaaatctggagaatggaaggtggctcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagctttatagtcccagtgataactacagaatatataagagagaaattatcatattctttttatggttctggaggaacttatgcattatctctttctcaatacaatatgaatataaacatagaattaaatgaaaatgatacttgggttatagatgtcgacaatgtcgtaagagatgtcactatagaatctgataaaattaaaaaaggagatttaatagagaatattttatctaaattaagtattgaagacaataaaattattttagataatcatgaaattaatttctctggaacattaaatggaggtaatggatttgtatctttaacattctcaatcttagaaggaataaatgcagttatagaagttgatttattatctaaatcatataaagttcttatttctggtgaactaaaaacattgatggcaaattcaaattctgttcaacagaaaatagattatataggattgaacagcgaattacaaaaaaatataccttatagttttatggatgataaaggaaaagaaaatggatttattaattgttctacaaaagaaggtttatttgtatctgaattatctgatgtagttcttataagtaaagtttatatggacaatagtaaacctctatttggatattgtagtaatgatttgaaagatgttaaagtcataactaaagatgacgttattatattaacaggatattatttaaaagatgatataaaaatctctctttcttttactatacaagatgaaaatactataaaattaaatggagtatatttagatgaaaatggagtagctgaaatattgaaatttatgaataaaaaaggtagtacaaatacttcagattctttaatgagctttttagaaagtatgaatataaaaagtattttcataaattccttacaatctaatactaagcttatattagatactaattttataataagtggtactacttctattggtcaatttgagtttatttgtgataaagataataatatacaaccatatttcattaagtttaatacactagaaactaaatatactctatatgtaggtaatagacaaaatatgatagtagaaccaaattatgatttagatgattctggagatatatcttcaactgtcattaatttttctcagaaatacctttatggaatagacagttgtgttaataaagttataatttcgccaaatatatatacagatgaaataaacataacacctatatatgaagcaaataatacttatccagaagtgattgtattagatacaaattatataagtgaaaaaatcaatattaatatcaatgatttatctatacgatatgtatggagtaatgatggaagtgattttattcttatgtcaactgatgaagagaacaaggtatcacaagttaaaataagatttactaatgtttttaaaggtaatactatatcagataagatatcttttaattttagtgataagcaagatgtatctataaataaagttatttcaacatttacaccttcatattatgtggaaggattacttaattatgatttaggtctgatttctttatacaatgagaaattttatattaataactttggaatgatggtgtctggattagtatatattaatgattcattatattatttcaagccaccaataaagaacttgataactggatttacaactataggtgatgataaatactactttaatccagataatggtggagctgcttcagtcggagaaacaataattgatggcaaaaactactacttcagccaaaatggagtgttacaaacaggtgtatttagtacagaagatggatttaaatattttgctccagcagatacacttgatgaaaatctagagggggaagcaattgattttactggcaaactaactattgatgaaaatgtttattattttggagataattatagagcagctatagaatggcaaacattagatgatgaagtgtactattttagtacagatacaggtagagcttttaaagggctaaatcaaataggtgatgataaattctatttcaactctgatggtattatgcaaaaaggatttgttaatataaatgataagacattctattttgatgattctggtgtgatgaagtcaggatatactgaaatagatggaaaatatttttactttgctgagaatggagaaatgcaaataggagtatttaatacagcagatggatttaaatattttgctcatcatgatgaagatttaggaaatgaagaaggtgaagcactttcatattctggtatacttaattttaacaataagatttattattttgatgattcatttacagcagtagttggatggaaggatttagaagatggttcaaaatattactttgatgaagatacagcagaagcatatataggtatctcaataattaatgatggtaaatattattttaatgattctggaatcatgcaaattggatttgtcacaataaataatgaagtattttatttctctgattctggaatagtagaatctggaatgcaaaatatagatgataattatttctatatagacgaaaatggtctagttcaaattggtgtatttgacacttcagatggatataaatactttgcaccagctaatactgtaaatgataatatctatggacaagcagttgaatatagtggtttagttagagttggtgaagatgtatattattttggagaaacatatacaattgagactggttggatatatgatatggaaaatgaaagtgataaatattatttcgatccagaaactaaaaaagcatataaaggtattaatgtaattgatgatataaaatactattttgatgagaatggaataatgagaacaggtcttataacatttgaagataatcattactattttaatgaagatggtattatgcaatatggttatctaaatatagaagataagacgttctactttagtgaagatggtattatgcagattggagtatttaatacaccagatggatttaaatattttgcacatcaaaatactttagatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 23 - protein, 2366 aa, Clostridium difficile; identical to SEQ ID NO: 21

SEQ ID NO: 24 - DNA, 7101 bp, Clostridium difficile; identical to SEQ ID NO: 22

SEQ ID NO: 25 - protein, 2366 aa, Clostridium difficile; identical to SEQ ID NO: 2

SEQ ID NO: 26 - DNA, 7101 bp, Clostridium difficile
atgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagatgttgatatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggcagtatgaatatccatttgatagaagctgatttaagaaactttgaaatctctaaaactaatatttctcaatcaactgaacaagaaatggctagcttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttacagctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggggaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 27 - DNA, 26039 bp, Clostridium difficile
agctagtcttggtgtattgttagcaggattttttaatttgccaattgaattagttgcagccgttggctatgctagtgtctttggtagtgctacaaatactttttttgcacctgtatttataggggcagaagtttttggatacagctatttaccttatttctttgtagtatgcgctatttcatatatatttaatatggataaatctatttattcactacaaaaaatttcaacaaaacaataaataaaacaacataatgtatgattagaagagaaagaatattagagaaaggatagggtaggaatatgttgacaagtttagctttgatttttttattaggaatggcctcgggaggtatttttaagaggataaagttacctaacttattgggaatgttacttacaggaattatattaggtccatatgttttaaatttgattgataattcaatactagatatttcttctgaccttagaaagattgcattgattattatattaacaagggctggattatctttagatataaacgatttgaagaaagtgggaagacctgctgtacttatgtgctttattccagctacttttgaaattatcggaatgatagttttagcaccaaagttactaggcgtttctatattggaagcagcagtcatgggtgcagtagtaggagcagtttctcctgcaattattgtacctaaaatgcttaaattaatggaagaaggttatggtacagaaaaaagtattccacagatgcttttagcaggaacttctatagacgatattttcgtaattgtgatgtttacagtattcacaggattggcacaaggaaatagtatatcagctattagttttttacaaattccagtatcaattatattaggtgtaatagctggagcagtgattggaatctgtttagcagtattttttaagaaggttcatatgagagattctgctaaaggggtgttgcttttaagtatctcatttttaatgataagtttagaaactgctttagagggtattgtgccattttctggattattagcagttatgagtattgggattttccttcagataaaatatcgtgtagttgcaagaagattgtctataaagtattcaaaactatgggttggcgctgaaattctcttgtttgttttggtaggggcaacagtagatataagttatgcatttaaagcaggaattggagctgtaattttaatatttggagttcttttattccgtatgtaggagtattcttctgccttattaagacaaatttgacaataaaggaaagattgttctgtatgattggctatattccaaaggctacagtacaggcagcaataggaggtgtaccacttgcaatggggatggcatctggacaacttattttgacgttagcagttctcgctatacttataactgcacctcttggagcttttggaattgatgtaacttataaaaaattattaacttctgtaaaaggcgagagtaagtaaaaataaagattattttaactggtaagttatattttggaaaaggattatactattgaatacaatataaaaaaatcatttgggagattaagaaggtagaagttaagaacagattttaaggtatgttatgattattagaattgattttgtgaaattattattgtaatatttaattatatagataaagaagcggagtgataactatgtgtttaaaaaaattatcaaaattagagttagttattatgaaatttatttggaatttagatataaaaaccaattcatatgagattattgattatatgaaagaagaacataatttaccagaaaaagtagctttaaaaactttatcaaaactatcaaagaaaaaattcttatatgttcaagaaacaggcaagtgtatgtattatacagttgcaataaaagaaaaggcatatttagagtttatatcaagaaatgtgcaaaatcttttgaagaataattttataaggaatttattagtatcatttcacgaagaggagctaacagaggaaaagataaagtcgttagaaaactgggtagtaaattgggaagaagcttatgtataaatgttattatttttattacaatttagataattttggttttgtaagctctgcaactatttttagatggttgcagagtttatttttattttttattcccttaagcaatacttaaaagtaaacgcatttatatttactaacttcaattacttctaatacttaaattactttttaaaaatattttgatatgtcatctctatagtaatctagaacttgtttctattctttatataaagtttttatgaatgatatatataatattcgttcatttgattaaaaataacaaaatattaaataattctactctgatagtttgttaaaaaaataataaaaaatattaataaacaaaaaaaaaattatcttaagagaggagaatgttataatataaaaaggtttctagatttcataaaagatactattttagtcttgaaaatatttagtttgaaaagattttaatttaatgattgattaagttaaaaatgtgtatgtaataaattttattttatttattgactaaattataaagtttacataattatttaataattatgtaattgttacttgaaaattgatctattttaaaatctagttataacttcaaaaaagactgaaaattaagaaaaaagaaatataaatataaaaatatgtcatatagattttttttattttactttaataaaatgatttgtttttacaatactttattaatataaagtttattgctaaaatactttatttattagaaaaagattactaattaattattaaaattaatgtattcataatgcatattttcatataaaatttaatttatttgccgattatataattataattactgatttaattccaatgttgttcaaaattttcaaataaagcatcattataaatataagagagggtgattttatgcaaaagtctttttatgaattaattgttttagcaagaaataactcagtagatgatttgcaagaaattttatttatgtttaagccattagtaaaaaaacttagtagagttttacattatgaagagggagaaacagatttaataatattttttattgaattaataaaaaatattaaattaagtagcttttcagaaaaaagcgatgctattatagtcaaatatattcataaatcattactgaataagacttttgagttgtctagaagatattctaaaatgaagtttaattttgtagaatttgatgaaaatatcttaaatatgaaaaataattatcaaagtaagtctgtttttgaggaagatatttgttttttcgaatatattttgaaagaattatctggtattcaaagaaaagttattttttataaatatttaaaaggatattctgatagagaaatatcagtgaaattaaaaatatctagacaagctgttaataaggctaaaaatagagcatttaaaaaaataaaaaaagactatgaaaattattttaacttgtaattaatgagcttaaagagatatttataatagaaatcaaattttagaattaactttattgtaaaatcaataacttaatctaagaatatcttaatttttatattttatatagaacaaagtttacatatttatttcagacaacgtctttattcaatcgaagagcaaattaatcaactgagtgtcttaaatttaaaatgttaggaagtgaatgtatatgaaaacctaagtagatattagtatattttataaatagaaaggaggatatataaaagagttttagcatttagatgtaaaaatattatagtaaaggagaaaattttatgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagatgttgatatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggcagtatgaatatccatttgatagaagctgatttaagaaactttgaaatctctaaaactaatatttctcaatcaactgaacaagaaatggctagcttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttacagctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggggaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatagataaaaatatgttaaatatatcctcttatacttaaatatataaaaataaacaaaatgatacactacataaagtgttctatctaatatgaagatttaccaataaaaaggtggactatgatgaatgcacagtagttcacctttttatatttctaatggtaacaaaatatttttttatataaacctaggaggcgttatgaatatgacaatatcttttttatcagagcatatatttataaagttagtaattttaactatatcatttgatacattattaggatgtttaagtgcaataaaaagtcgtaaatttaattctagttttggaatagatggaggaatcagaaaagtagcaatgatagcatgtatattttttttatcagtagttgacattcttacaaagtttaactttttatttatgttaccacaagattgtatcaattttttaagactaaaacatcttggaatatctgaatttttctctattttatttattttatatgaaagtgtaagtatattaaaaaatatgtgcttatgtggattaccagtacctaagagattaaaggaaaaaatagcaattttactagatgcaatgacagatgaaatgaatgctaaggatgaaaagtaagtaatggtagatataataaagatattaacaaataaaaagtgttatccaaataagaatagctgaaagttatcataattcatgaaactaataatgaaaacgagggagcagatgccaagagacacacaagtattaaatacatataatttcgaagcaagtgttcattactatatagatgacaaggtagtatatcaaacattggttcacaaagatggtgcatggtcagttggtaaaatctattaagctacattagttacagatatcacaaactataatagttaaacatagaaatatgtgtaaattgtgatggaaattattcaaaaacacaaaaatacgtgatgaaggacaaaatgatatagaaaataagtatcaaaccttaataaatgatttaattgatagtttaaaagttataggaaaaatatataaagaaataaaaacattaaaaaaatataagatatgtttacaaattactatcagacaatctccttatctaatagaagagtcaattaactaattgagtatctttaaattgaaatgttaggaagtgatttaaatatgaaaacttaaattataaaaaatcaatattaatttatttttaaaaaatagaaaggagtgtataagatttattttcaaagtttaaaaacaagaaaatcaatttaaatttcagaaggaataaatgtggttatagaagtggatttattatcaaaaataataatactaggaggtttttatgtctttaatatctaaagaagagttaataaaactcgcatatagcattagaccaagagaaaatgagtataaaactatactaactaatttagacgaatataataagttaactacaaacaataatgaaaataaatatttgcaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagatgttgatatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggggattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatactattgagaaaatcaatactttaggcctagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatataaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaactagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataataactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggattgcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatacggatgctaacaacatagaaggtcaagctatactttaccaaaataaattcttaactttgaatggtaaaaaatattactttggtagtgactcaaaagcagttaccggactgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcggctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccctgggatatatggctaaaatatatgtttgataaaaaattattcctgtgctactaagaaattatttttatataataaatattgagatttaattaaaagtcatgtgttattgtaatacatgacttttagttaaaatttttctatcatttaataatctattattcttgactattttataataaaattcatatatggaaatattaatactaaataattaatagttgataaaaaatagataatatgctaaaagcaaaaactaatttagagccttgtaactgtttatttgcaattataaaaacatctttaaacatattgactataatataaaatattaactataatacaaaacaatattaattaattttctctacagctatccctggtatagttatatttccacccatagttgattcataagttatagttccagcacttatacctcttatagttatgtaatcatcctctaatactcttgaaggagttattgattttttataactacatagtacaaccttatcataatttccagacacagctaatcttatttgcacctcatcaccatcttcaataacttgaataaccttaccttcaaatttaccttttgtactataatcatcaggtgttctagctaattggtcataagtaataccagtatcatatcctttcttctcctcttcttcttttttgcgttgttcttcagcctttttagcttcttcagcttttttagcttcttcagctttacgttgattttcagcttcaatagctttcttttcgtcgtctttcattttgaaccatggttcagcatcagacaatttgctatttaaagtttctatttctgttttttgagaatctataactgatgtttggttagaaatgacctcctcatggtcttcagaacaagctggtgaggatatattgccaaaaaacacgcctaaaataaatgccagtagagcaataccctttgtgctcttaaagaatttaattattttcttagagcttccttttccttcattactaaattcgttaccctcattttttttagaaaacataatacaatctcccttttattagatatattttattttaaaagttaaaaacttaaaataactagttgactaaaaattatatattcatattttcctaaaatatatttcccctaagcataattttacaaaataaagtaagaagattcaatatattttgaaaaaataagataaaaatgtcagattataatataattttcttgaaggtgaattttatatattaaattaaacataaagtattttatttgtataaaactatattatgatgtaattaagtgactcagtgatttagaggtggtaaaatatatatatatgaaagagcataaataaattgatataataaaaaattaaatattaaatattaactataataaaaaaatatctggtaataggtataatataaaaagaatataccagaaagaaggtgaagtatgggagaactacaaaaaattccaggggtagggaaagcaacagaaaaatctttaatcatgttaggatatacaactattaaatcacttaaagatgcaaacccagcacaaatgtatgaaaaggaatgtttaatgcgtggacagcacatagacagatgtcagttatatgtatacagatgtgcagtatattttgcatcaactgaaaatccagaaccagaaaaattaaagtggtggtattggaaagattaaaaaatcaaaaaagttagacataaaaaagagttgaatatccgttttaaataataaaaactaatactcaactcttttttagtcgtaaattttatgtaaatctatttgtatggctaaatatacccatcaataaatgtataaatataccaatcaacaaatgactaaacatactacctaacaaaggattaaataaattacttaacaaagcattctaaaacaattaattagaaactgtttcttcaagccattttctacattgctcaatatttaccatagggtcaaaaccttggtcttttcccttatttaaaagcatatcacaagggaaagtatcacattcaccacaatgattaagttccttactttcacagcaagttttaaccttacattctccaccccaaaatggtttttccatagttgggcaaccagtgcaatttacttgttctttttttgtacaactgtcacaacagacaccacatcttgattcaaacatgttcaaacatcctttccattatttaaaaatattataaaatgattttagatgaatacaaaagtgcaaatagttgattttaggtcatctaaatgttaaacataaagttattagtactggtaaatttataaaaactattccaaaaatctttttgaatatttcaaaacacaataaattacttcaaatccctttgaatatattttacagcattatagattgctttaaatctctttgaatattctacaagactatagattagtttaaatctctttgagtattctacaagactatagattagtttaaatccctttgaatatttcaaaacaccatagattactttaaattcctttgaatattctataacactataaattacttttaacttttatataaccataaagtttttatctggcactttaaatggagttttatatcaaatttgccttccatcgaataaccaaacttaatttaattacacattccaagagtcaaatattcattcaatatatttgataattctatgttatagctataattaaatatagattattaaagttaaatatttatttaatatattgaatgattttttacctatatttaattaagtttcattatataatataaaaattgtttttgcattaagttttaatataatacataataattttaaataataatattattatatattttttaattttaggagtatatctattatatagcgagtagataaaacatataaaattcaaataaaagatatatatttttaaattaaaatggatatagatttcaactaaaaagaatataaatttcaaacccaaaaatatctagcatttaccattaagaaataacatcattctttctaaaatttctattggcaatttcagaaaatactatagtagtaataaatgcaacacatattgtaactatagtgtcattaacatttaaagcagattgctttataacccccatacgactacctaacatagaataagggaaaaatataccaacagcaggttttgctactattaatcccataccaaatagagaaaggcaaagactaataccaataggagttgcaaaacttctaatctttatagacatgtataattgtatagaagctattgaaatagaaataatccaacctttagcaatccaaccagtcaattctttaggtacactaccagaaaaaccaaacatatttcctgcaactatataaaagataacaaagaaaacttgtgtaatagctgtaagtattgaaactactgtaagtttagataaaaagatattttttaaattaactggcagtgtcattacattattccaattatgattcatatgttcaagcctacaaatatatgcacaaaagattgcgattaagataggaaagaaaaattccccataaaaaagactaacttgagtccataagctgtaccattcttttttgagtatgccttgatttagataaaaattaccagaaccaatcaacacacttataagtggcaaagctagtaatacataccatataaaagaattttttaactttagaatttctcccaaaactgacttccttaacatttaaatccctcctatacttctttttttaataaatgatttcttccaatataataaattagcattccaattaagaaaactaaaatcgtaatagaaaaattcatatcaattctatagacagatgaacctaaaacattatcataagcataacttaaaggtgataactctaggtaataagaccatataaacaatctacgaataccttgataaaacaaacctgatgtcaaacctataaaactaccaatcatgccaaatgtaattgcaatcatttgatttggaattacagttgcaatccataggtgtagtgcaatgatagcaatacttacaagaattgttcctaatgtgtattttaaaagtaaagatacagaaattgactcaataacccctctaaaatgtccaaacaacacaatagataacacttgcatcaatacaggtatagataccaaaatagcagaacataaaaatttagataaataaatagtatttaaagatgtcacagaagattttaaaagcttccatgtatctcctttatgttctatatcgcttatacgtgatgtaattattgatattaagataggaaagaatagaccatttaaacttgcaaaactcataagcatataggaatattcaaatccacctaacatatctggattacgtgtaatagccctatttgaatttacgatacaccacattatttcaacagctacaaataaaaaggtcatcagaataatcttctttcttttaagtttataaaattctagaccaaggtatttcattataaagtcaccgccttaccagtaattctaagaatatatcttccaagctttttttatgttcttctattctaaatacatctatatttgaatggacaagcataccatttattttagcgacatctgagtcttttaaattttcaatagtcaagtacccatcttgtataagtgacatatatcctttagtatttaatagtttttgtgcagatacaacattcttagttttgatagcaatctgactttgacctctattatgaagttcttttatgctatcttgaaaaaccagttcgccatgatttattattcctattgatgtggcaatttggtcaatttcacttaaaagatggctagagattagaacagtcatcccgtatttttctggtagagattttattaattctctaatttcctcaatccctgctgggtcgagtccatttgtaggttcatcaagtattaataatttgggaaacttcattattgccatagcaatgccaagacgttgcttcatacctaaagaatattgactaacttttttatttttttgattttctaaccttacaatttttaatgcttcatttacattttttttaggtaaatctaagagtctttgcattatggtcatgttttcaagccctgtaagatgaccatagtatgatggagattctatcaaagaacctatatcttttaaaattgatattctatttttttcatttaactctttacctaaaatattaatatttccttgtgtgggtttagcaagtccaagaagcattttaagagtggtagattttccagctccattaggacccaaaaaaccatatacagctccttgtggaactcttaggtctatatcctttactctaaatattttattgtattcctttgaaagtctttgtgttctaattatcatttccatatgtttcatccccttttttaatctgtgcttattgattcttttaacttatatcagtataataacttggttacatttcaattagctgaaatttaccttacaataaccttaaaagtctatttaggcaaagttgtgaaaatgggtatatggtatac

SEQ ID NO: 28 - protein, 193 aa, Clostridium difficile
WIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIH

SEQ ID NO: 29 - protein, 542 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSL

SEQ ID NO: 30 - protein, 193 aa, Clostridium difficile
VWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGI

SEQ ID NO: 31 - protein, 543 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSL

SEQ ID NO: 32 - protein, 267 aa, Clostridium difficile
SEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTL

SEQ ID NO: 33 - protein, 224 aa, Clostridium difficile
GEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEES

SEQ ID NO: 34 - protein, 2710 aa, Artificial
  Synthetic amino acid sequence: mutant C. difficile TcdA
  MISC_FEATURE (101)..(101): Xaa is any amino acid
  MISC_FEATURE (269)..(269): Xaa is any amino acid
  MISC_FEATURE (272)..(272): Xaa is any amino acid
  MISC_FEATURE (285)..(285): Xaa is any amino acid
  MISC_FEATURE (287)..(287): Xaa is any amino acid
  MISC_FEATURE (460)..(460): Xaa is any amino acid
  MISC_FEATURE (462)..(462): Xaa is any amino acid
  MISC_FEATURE (541)..(541): Xaa is any amino acid
  MISC_FEATURE (542)..(542): Xaa is any amino acid
  MISC_FEATURE (543)..(543): Xaa is any amino acid
  MISC_FEATURE (589)..(589): Xaa is any amino acid.
  MISC_FEATURE (655)..(655): Xaa is any amino acid.
  MISC_FEATURE (700)..(700): Xaa is any amino acid.
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVXIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASXIVXLLALKNFGGVYLXVXMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPXAXSTISLSGPGAYASAYYDFINLQENTIEKTLKASDLIEFKFPENNLSQLTEQEINSLWSFDQASAKYQFEKYVRDYTGGXXXEDNGVDFNKNTALDKNYLLNNKIPSNNVEEAGSKNYVHYIIQLQGXDISYEATCNLFSKNPKNSIIIQRNMNESAKSYFLSDDGESILELNKYRIPERLKNKEKVKVTFIGXGKDEFNTSEFARLSVDSLSNEISSFLDTIKLDISPKNVEVNLLGXNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 35 - protein, 2366 aa, Artificial
  Synthetic amino acid sequence: mutant C. difficile TcdB
  MISC_FEATURE (102)..(102): Xaa is any amino acid.
  MISC_FEATURE (270)..(270): Xaa is any amino acid.
  MISC_FEATURE (273)..(273): Xaa is any amino acid.
  MISC_FEATURE (286)..(286): Xaa is any amino acid.
  MISC_FEATURE (288)..(288): Xaa is any amino acid.
  MISC_FEATURE (384)..(384): Xaa is any amino acid.
  MISC_FEATURE (520)..(520): Xaa is any amino acid.
  MISC_FEATURE (543)..(543): Xaa is any amino acid.
  MISC_FEATURE (544)..(544): Xaa is any amino acid.
  MISC_FEATURE (587)..(587): Xaa is any amino acid.
  MISC_FEATURE (600)..(600): Xaa is any amino acid.
  MISC_FEATURE (653)..(653): Xaa is any amino acid.
  MISC_FEATURE (698)..(698): Xaa is any amino acid.
  MISC_FEATURE (751)..(751): Xaa is any amino acid.
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVXIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASXILXISALKEIGGMYLXVXMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIIXQGLISVKDSYCSNLIVKQIENRYKILNNSLNPAISEDNDFNTTTNTFIDSIMAEANADNGRFMMELGKYLRVGFFPAVATTINLSGPEAYAAAYQDLLMFKEGSMNIHLIEADLRNFEISKTNISQSTEQEMASLXSFDDARAKAQFEEYKRNYFEGSXXEDDNLDFSQNIVVDKEYLLEKISSLARSSERGYIHYIVQLQGXKISYEAACNLFAXTPYDSVLFQKNIEDSEIAYYYNPGDGEIQEIDKYKIPSIISDRPKIKLTFIGXGKDEFNTDIFAGFDVDSLSTEIEAAIDLAKEDISPKSIEINLLGXNMFSYSINVEETYPGKLLLKVKDKISELMPSISQDSIIVSANQYEVRINSEGXRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 36 - protein, 146 aa, Artificial
  Synthetic amino acid sequence: variable light chain of A3-25 mAb IgE
MKLPVRLLVLMFWIPGSSSDVVMTHTPLSLPVSLGDQASMSCRSSQSLIHSNGNTYLHWYLQKPGQSPKLLISKVSNRFSGVPDRFSGSGSGTDFTLKISRVEAEDLGVYFCSQTTYFPYTFGGGTRLEIKRADAAPTVSIFPPSS

SEQ ID NO: 37 - protein, 189 aa, Artificial
  Synthetic amino acid sequence: variable heavy chain of A3-25 mAb IgE
MYLGLNCVFIVFLLKGVQSEVNLEESGGGLVQPGGSMKLSCVASGFTFTNYWMNWVRQSPEKGLEWIAEIRLKSHNYATHFAESVKGRFTISRDDSKSAVSLQMTNLTPEDTGIFYCTWDYYGNPAFVYWGQGTLVTVSAASIRNPQLYPLKPCKGTASMTLGCLVKDYFPGPVTVTWYSDSLNMSTVN

SEQ ID NO: 38 - protein, 16 aa, Artificial
  Synthetic amino acid sequence: CDR1 of the variable light chain of A3-25 mAb
RSSQSLIHSNGNTYLH

SEQ ID NO: 39 - protein, 7 aa, Artificial
  Synthetic amino acid sequence: CDR2 of the variable light chain of A3-25 mAb
KVSNRFS

SEQ ID NO: 40 - protein, 9 aa, Artificial
  Synthetic amino acid sequence: CDR3 of the variable light chain of A3-25 mAb
SQTTYFPYT

SEQ ID NO: 41 - protein, 10 aa, Artificial
  Synthetic amino acid sequence: CDR1 of the variable heavy chain of A3-25 mAb
GFTFTNYWMN

SEQ ID NO: 42 - protein, 19 aa, Artificial
  Synthetic amino acid sequence: CDR2 of the variable heavy chain of A3-25 mAb
EIRLKSHNYATHFAESVKG

SEQ ID NO: 43 - protein, 10 aa, Artificial
  Synthetic amino acid sequence: CDR3 of the variable heavy chain of A3-25 mAb
DYYGNPAFVY

SEQ ID NO: 44 - DNA, 8142 bp, Artificial
  Synthetic nucleotide sequence: TcdA gene (D285A D287A mutations)
catatgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagcagttgcaatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggtgattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatattattgagaaaatcaatactttaggactagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagcaggtggacttttcgagattgatggtgttatatatttctttggtgttgatggagtaaaagcccctgggatatatggctaaagatct

SEQ ID NO: 45 - DNA, 8136 bp, Artificial
  Synthetic nucleotide sequence: TcdA gene (D285A D287A  C700A mutations)
catatgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagcagttgcaatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggagctaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggtgattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatattattgagaaaatcaatactttaggactagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagcaggtggacttttcgagattgatggtgttatatatttctttggtgttgatggagtaaaagcccctgggatatatggctaa

SEQ ID NO: 46 - DNA, 7110 bp, Artificial
  Synthetic nucleotide sequence: TcdB (D286A D288A mutations)
catatgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagcagttgcaatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcttatgcggcagcttatcaagatttattaatgtttaaagaaggcagtatgaatatccatttgatagaagctgatttaagaaactttgaaatctctaaaactaatatttctcaatcaactgaacaagaaatggcttctttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttactgctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatagagatct

SEQ ID NO: 47 - DNA, 7104 bp, Artificial
  Synthetic nucleotide sequence: TcdB (D286A D288A C698A mutations)
catatgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagcagttgcaatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcttatgcggcagcttatcaagatttattaatgtttaaagaaggcagtatgaatatccatttgatagaagctgatttaagaaactttgaaatctctaaaactaatatttctcaatcaactgaacaagaaatggcttctttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggagctaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttactgctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 48 - DNA, 21 bp, Artificial Sequence
  Synthetic nucleic acid sequence
tcgtcgtttttcggtgctttt

SEQ ID NO: 49 - protein, 118 aa, Artificial Sequence
  Synthetic amino acid sequence
QVQLQQPGAELVKPGAPVKLSCKASGYSFTSYWMNWVKQRPGRGLEWIGRIDPSNSEIYYNQKFKDKATLTVDKSSSTAYIQLSSLTSEDSAVYYCASGHYGSIFAYWGQGTTLTVSS

SEQ ID NO: 50 - protein, 19 aa, Artificial Sequence
  Synthetic amino acid sequence
MGWSCIILFLVATATGVHS

SEQ ID NO: 51 - protein, 10 aa, Artificial Sequence
  Synthetic amino acid sequence
GYSFTSYWMN

SEQ ID NO: 52 - protein, 15 aa, Artificial Sequence
  Synthetic amino acid sequence
RIDPSNSEIYYNQKF

SEQ ID NO: 53 - protein, 9 aa, Artificial Sequence
  Synthetic amino acid sequence
GHYGSIFAY

SEQ ID NO: 54 - protein, 17 aa, Artificial Sequence
  Synthetic amino acid sequence
AKTTPPSVYPLAPGNSK

SEQ ID NO: 55 - protein, 125 aa, Artificial Sequence
  Synthetic amino acid sequence
VQITQSPSYLAASPGETITINCRASKSISKYLAWYQEKPGKTNKLLLYSGSTLQSGIPSRFSGSRSGTDFTLIISSLEPEDSAMYYCQQHNEYPLTFGAGTKLELKRADAAPTVSIFPPSSEEFQ

SEQ ID NO: 56 - protein, 21 aa, Artificial Sequence
  Synthetic amino acid sequence
MRFQVQVLGLLLLWISGAQCD

SEQ ID NO: 57 - protein, 11 aa, Artificial Sequence
  Synthetic amino acid sequence
RASKSISKYLA

SEQ ID NO: 58 - protein, 7 aa, Artificial Sequence
  Synthetic amino acid sequence
SGSTLQS

SEQ ID NO: 59 - protein, 9 aa, Artificial Sequence
  Synthetic amino acid sequence
QQHNEYPLT

SEQ ID NO: 60 - protein, 121 aa, Artificial Sequence
  Synthetic amino acid sequence
QVQLQQPGAELVKPGASVKLSCKASGYTFTSYWMHWVKQRPGQGLEWIGVINPSNGRSTYSEKFKTTATVTVDKSSSTAYMQLSILTSEDSAVYYCARAYYSTSYYAMDYWGQGTSVTVSS

SEQ ID NO: 61 - protein, 19 aa, Artificial Sequence
  Synthetic amino acid sequence
MGWSYIILFLVATATDVHS

SEQ ID NO: 62 - protein, 10 aa, Artificial Sequence
  Synthetic amino acid sequence
GYTFTSYWMH

SEQ ID NO: 63 - protein, 15 aa, Artificial Sequence
  Synthetic amino acid sequence
VINPSNGRSTYSEKF

SEQ ID NO: 64 - protein, 12 aa, Artificial Sequence
  Synthetic amino acid sequence
AYYSTSYYAMDY

SEQ ID NO: 65 - protein, 17 aa, Artificial Sequence
  Synthetic amino acid sequence
AKTTPPSVYPLAPGNSK

SEQ ID NO: 66 - protein, 130 aa, Artificial Sequence
  Synthetic amino acid sequence
VLMTQSPLSLPVSLGDQASISCRSSQNIVHSNGNTYLEWYLQKPGQSPKLLIYKVSNRFSGVPDRFSGSGSGTYFTLKISRVEAEDLGVYYCFQGSHFPFTFGTGTKLEIKRADAAPTVSIFPPSSEEFQ

SEQ ID NO: 67 - protein, 20 aa, Artificial Sequence
  Synthetic amino acid sequence
MKLPVRLLVLMFWIPASSSD

SEQ ID NO: 68 - protein, 16 aa, Artificial Sequence
  Synthetic amino acid sequence
RSSQNIVHSNGNTYLE

SEQ ID NO: 69 - protein, 7 aa, Artificial Sequence
  Synthetic amino acid sequence
KVSNRFS

SEQ ID NO: 70 - protein, 9 aa, Artificial Sequence
  Synthetic amino acid sequence
FQGSHFPFT

SEQ ID NO: 71 - protein, 118 aa, Artificial Sequence
  Synthetic amino acid sequence
QVQLQQPGAEVVKPGAPVKLSCKASGYPFTNYWMNWVKQRPGRGLEWIGRIDPSNSEIYYNQKFKDKATLTVDKSSSTAYIQLSSLTSEDSAVYYCASGHYGSIFAYWGQGTTLTVSS

SEQ ID NO: 72 - protein, 19 aa, Artificial Sequence
  Synthetic amino acid sequence
MGWSCIILFLVATATGVHS

SEQ ID NO: 73 - protein, 10 aa, Artificial Sequence
  Synthetic amino acid sequence
GYPFTNYWMN

SEQ ID NO: 74 - protein, 15 aa, Artificial Sequence
  Synthetic amino acid sequence
RIDPSNSEIYYNQKF

SEQ ID NO: 75 - protein, 9 aa, Artificial Sequence
  Synthetic amino acid sequence
GHYGSIFAY

SEQ ID NO: 76 - protein, 17 aa, Artificial Sequence
  Synthetic amino acid sequence
AKTTPPSVYPLAPGNSK

SEQ ID NO: 77 - protein, 125 aa, Artificial Sequence
  Synthetic amino acid sequence
VQITQSPSYLAASPGETITINCRASKSISKYLAWYQEKPGKTNKLLIYSGSTLQSGIPSRFSGSRSGTDFTLIISSLEPEDSAMYYCQQHNEYPLTFGAGTKLELKRADAAPTVSIFPPSSEEFQ

SEQ ID NO: 78 - protein, 21 aa, Artificial Sequence
  Synthetic amino acid sequence
MRFQVQVLGLLLLWISGAQCD

SEQ ID NO: 79 - protein, 11 aa, Artificial Sequence
  Synthetic amino acid sequence
RASKSISKYLA

SEQ ID NO: 80 - protein, 7 aa, Artificial Sequence
  Synthetic amino acid sequence
SGSTLQS

SEQ ID NO: 81 - protein, 9 aa, Artificial Sequence
  Synthetic amino acid sequence
QQHNEYPLT

SEQ ID NO: 82 - protein, 2366 aa, Artificial Sequence
  Synthetic amino acid sequence
  MISC_FEATURE (102)..(102): Xaa is any amino acid.
  MISC_FEATURE (270)..(270): Xaa is any amino acid.
  MISC_FEATURE (273)..(273): Xaa is any amino acid.
  MISC_FEATURE (286)..(286): Xaa is any amino acid.
  MISC_FEATURE (288)..(288): Xaa is any amino acid.
  MISC_FEATURE (384)..(384): Xaa is any amino acid.
  MISC_FEATURE (461)..(461): Xaa is any amino acid.
  MISC_FEATURE (463)..(463): Xaa is any amino acid.
  MISC_FEATURE (520)..(520): Xaa is any amino acid.
  MISC_FEATURE (543)..(543): Xaa is any amino acid.
  MISC_FEATURE (544)..(544): Xaa is any amino acid.
  MISC_FEATURE (587)..(587): Xaa is any amino acid.
  MISC_FEATURE (600)..(600): Xaa is any amino acid.
  MISC_FEATURE (653)..(653): Xaa is any amino acid.
  MISC_FEATURE (698)..(698): Xaa is any amino acid.
  MISC_FEATURE (751)..(751): Xaa is any amino acid.
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVXIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASXILXISALKEIGGMYLXVXMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIIXQGLISVKDSYCSNLIVKQIENRYKILNNSLNPAISEDNDFNTTTNTFIDSIMAEANADNGRFMMELGKYLRVGFFPXVXTTINLSGPEAYAAAYQDLLMFKEGSMNIHLIEADLRNFEISKTNISQSTEQEMASLXSFDDARAKAQFEEYKRNYFEGSXXEDDNLDFSQNIVVDKEYLLEKISSLARSSERGYIHYIVQLQGXKISYEAACNLFAXTPYDSVLFQKNIEDSEIAYYYNPGDGEIQEIDKYKIPSIISDRPKIKLTFIGXGKDEFNTDIFAGFDVDSLSTEIEAAIDLAKEDISPKSIEINLLGXNMFSYSINVEETYPGKLLLKVKDKISELMPSISQDSIIVSANQYEVRINSEGXRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 83 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASAIVALLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPAAASTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 84 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 85 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPAVATTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 86 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 87 - protein, 2710 aa, Clostridium difficile; identical to SEQ ID NO: 15

SEQ ID NO: 88 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 89 - protein, 2710 aa, Clostridium difficile; identical to SEQ ID NO: 15

SEQ ID NO: 90 - protein, 2710 aa, Clostridium difficile; identical to SEQ ID NO: 88

SEQ ID NO: 91 - protein, 2710 aa, Clostridium difficile; identical to SEQ ID NO: 88

SEQ ID NO: 92 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDVNTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 93 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEVATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAETATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 94 - protein, 2710 aa, Clostridium difficile; identical to SEQ ID NO: 92

SEQ ID NO: 95 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEVATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 96 - protein, 2710 aa, Clostridium difficile; identical to SEQ ID NO: 15

SEQ ID NO: 97 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTYNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 98 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 99 - protein, 2710 aa, Clostridium difficile; identical to SEQ ID NO: 95

SEQ ID NO: 100 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMKIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTYNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 101 - protein, 2710 aa, Clostridium difficile; identical to SEQ ID NO: 95

SEQ ID NO: 102 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNTKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTLSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTDANNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGNIYYFGNNSKAVTGWQTINGKVYYFMPDTAMAAAGGLFEIDGVIYFFGVDGVKAPGIYG

SEQ ID NO: 103 - protein, 2710 aa, Clostridium difficile; identical to SEQ ID NO: 102

SEQ ID NO: 104 - protein, 2710 aa, Clostridium difficile; identical to SEQ ID NO: 102

SEQ ID NO: 105 - protein, 2710 aa, Clostridium difficile; identical to SEQ ID NO: 88

SEQ ID NO: 106 - protein, 2710 aa, Clostridium difficile; identical to SEQ ID NO: 92

SEQ ID NO: 107 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 108 - protein, 2710 aa, Clostridium difficile; identical to SEQ ID NO: 88

SEQ ID NO: 109 - protein, 2710 aa, Clostridium difficile; identical to SEQ ID NO: 15

SEQ ID NO: 110 - protein, 2366 aa, Clostridium difficile; identical to SEQ ID NO: 21

SEQ ID NO: 111 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 112 - protein, 2366 aa, Clostridium difficile; identical to SEQ ID NO: 21

SEQ ID NO: 113 - protein, 2366 aa, Clostridium difficile; identical to SEQ ID NO: 111

SEQ ID NO: 114 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYRFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 115 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 116 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVDMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGCNMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIEREISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 117 - protein, 2366 aa, Clostridium difficile; identical to SEQ ID NO: 115

SEQ ID NO: 118 - protein, 2366 aa, Clostridium difficile; identical to SEQ ID NO: 116

SEQ ID NO: 119 - protein, 2366 aa, Clostridium difficile; identical to SEQ ID NO: 21

SEQ ID NO: 120 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTDYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 121 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVIEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKHKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVTDKEYLLEKISSSTKSSERGYVHYIVQLQGDKISYEAACNLFAKNPYDSILFQKNIEDSEVAYYYNPTDSEIQEIDKYRIPDRISDRPKIKLTFIGHGKAEFNTDIFAGLDVDSLSSEIETAIGLAKEDISPKSIEINLLGCNMFSYSVNVEETYPGKLLLRVKDKVSELMPSMSQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKVMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENNNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFDPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 122 - protein, 2366 aa, Clostridium difficile; identical to SEQ ID NO: 111

SEQ ID NO: 123 - protein, 2366 aa, Clostridium difficile; identical to SEQ ID NO: 116

SEQ ID NO: 124 - protein, 2366 aa, Clostridium difficile; identical to SEQ ID NO: 115

SEQ ID NO: 125 - protein, 2366 aa, Clostridium difficile; identical to SEQ ID NO: 116

SEQ ID NO: 126 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVIDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALYDLKQQNELEESHFISFEDISETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSSPSITYREPHLSIYDVLEVKKEELDLSKDLMVLPNAPNRVFGWETGWTPGLRGLENDGTKLLDRIRDQYEGQFYWRFFAFIADALITTLKPRYEDTNVRISLDSNTRSFIVPVITTEYIREKLSYSFYGSGGTYALSLSQYNMNINIELNENDTWVIDVDNVVRSVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLIIKVYMDNSKPPFGYYSNDLKDVKAITKDDVIILTGYYLKDDIKISLSFTIQDKNTIKLNGVYLDENGVAEILKFMNKKGSTNTSDSLMSFLESMNIKSIFIKSLKSNAKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYHLGLISLYNEKFYINNFGMMVSGLVYINDSLYYFKPPIKNLITGFTTIGDDKYYFNPDNGGAASVGETIIDGKNYYFSPNGVLQTGVFSTEDGFKYFAPADTLDENLEGEAIDFTGKLIIDENVYYFGDNYRAAIEWQTLDDEVYYFSTDTGRAFKGLNQIGDDKFYFNSDGIMQKGFVNINDKTFYFDDSGVMKSGYTEIDGKHFYFAENGEMQIGVFNTADGFKYFAHHDEDLGNEEGEALSYSGILNFNNKIYYFDDSFTAVVGWKDSEDGSKYYFDEDTAEAYIGISTINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYINIEDKMFYFNEDGVMQIGVFNTADGFKYFAHQNTLDENFEGESINYTGWLDLDEKRYYFTDEYIAAIGSVIIDGEEYYFDPDTAELVISE

SEQ ID NO: 127 - protein, 2367 aa, Clostridium difficile; identical to SEQ ID NO: 126

SEQ ID NO: 128 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVIDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALYDLKQQNELEESHFISFEDISETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSSPSITYREPHLSIYDVLEVKKEELDLSKDLMVLPNAPNRVFGWETGWTPGLRGLENDGTKLLDRIRDQYEGQFYWRFFAFIADALITTLKPRYEDTNVRISLDSNTRSFIVPVITTEYIREKLSYSFYGSGGTYALSLSQYNMNINIELNENDTWVIDVDNVVRSVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKDGLFVSELSDVVLIIKVYMDNSKPPFGYYSNDLKDVKAITKDDVIILTGYYLKDDIKISLSFTIQDKNTIKLNGVYLDENGVAEILKFMNKKGSTNTSDSLMSFLESMNIKSIFIKSLKSNAKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYHLGLISLYNEKFYINNFGMMVSGLVYINDSLYYFKPPIKNLITGFTTIGDDKYYFNPDNGGAASVGETIIDGKNYYFSPNGVLQTGVFSTEDGFKYFAPADTLDENLEGEAIDFTGKLIIDENVYYFGDNYRAAIEWQTLDDEVYYFSTDTGRAFKGLNQIGDDKFYFNSDGIMQKGFVNINDKTFYFDDSGVMKSGYTEIDGKHFYFAENGEMQIGVFNTADGFKYFAHHDEDLGNEEGEALSYSGILNFNNKIYYFDDSFTAVVGWKDSEDGSKYYFDEDTAEAYIGISTINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYINIEDKMFYFNEDGVMQIGVFNTADGFKYFAHQNTLDENFEGESINYTGWLDLDEKRYYFTDEYIAAIGSVIIDGEEYYFDPDTAELVISE

SEQ ID NO: 129 - protein, 2366 aa, Clostridium difficile; identical to SEQ ID NO: 111

SEQ ID NO: 130 - protein, 2366 aa, Clostridium difficile; identical to SEQ ID NO: 115

SEQ ID NO: 131 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMLSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 132 - protein, 2366 aa, Clostridium difficile; identical to SEQ ID NO: 111

SEQ ID NO: 133 - protein, 2366 aa, Clostridium difficile; identical to SEQ ID NO: 21

SEQ ID NO: 134 - protein, 2710 aa, Clostridium difficile; identical to SEQ ID NO: 88

SEQ ID NO: 135 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 136 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGNKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKGIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 137 - protein, 2710 aa, Clostridium difficile; identical to SEQ ID NO: 136

SEQ ID NO: 138 - protein, 2710 aa, Clostridium difficile; identical to SEQ ID NO: 88

SEQ ID NO: 139 - protein, 2710 aa, Clostridium difficile; identical to SEQ ID NO: 97

SEQ ID NO: 140 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPNTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 141 - protein, 2366 aa, Clostridium difficile; identical to SEQ ID NO: 111

SEQ ID NO: 142 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 143 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDSRAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 144 - protein, 2366 aa, Clostridium difficile; identical to SEQ ID NO: 143

SEQ ID NO: 145 - protein, 2366 aa, Clostridium difficile; identical to SEQ ID NO: 143

SEQ ID NO: 146 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQEMASLWSFDDSRAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 147 - protein, 2366 aa, Clostridium difficile; identical to SEQ ID NO: 146

SEQ ID NO: 148 - protein, 2710 aa, Clostridium difficile; identical to SEQ ID NO: 88

SEQ ID NO: 149 - protein, 2710 aa, Clostridium difficile; identical to SEQ ID NO: 88

SEQ ID NO: 150 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTYNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 151 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQGLLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 152 - protein, 2710 aa, Clostridium difficile; identical to SEQ ID NO: 98

SEQ ID NO: 153 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFASDSKAVTGLRTIDGKKYYFNTNTAVAATGWQTINGKKYYFNTNTSIASTGYTIINGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 154 - protein, 2710 aa, Clostridium difficile; identical to SEQ ID NO: 88

SEQ ID NO: 155 - protein, 2710 aa, Clostridium difficile; identical to SEQ ID NO: 98

SEQ ID NO: 156 - protein, 2710 aa, Clostridium difficile; identical to SEQ ID NO: 151

SEQ ID NO: 157 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYENTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTSIASTGYTSINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 158 - protein, 2366 aa, Clostridium difficile; identical to SEQ ID NO: 111

SEQ ID NO: 159 - protein, 2366 aa, Clostridium difficile; identical to SEQ ID NO: 111

SEQ ID NO: 160 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPGLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 161 - protein, 2366 aa, Clostridium difficile; identical to SEQ ID NO: 160

SEQ ID NO: 162 - protein, 2366 aa, Clostridium difficile; identical to SEQ ID NO: 160

SEQ ID NO: 163 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVDMLPGIQPGLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGCNMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIRGEISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGVASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 164 - protein, 2366 aa, Clostridium difficile; identical to SEQ ID NO: 163

SEQ ID NO: 165 - protein, 2366 aa, Clostridium difficile; identical to SEQ ID NO: 163

SEQ ID NO: 166 - protein, 2366 aa, Clostridium difficile; identical to SEQ ID NO: 163

SEQ ID NO: 167 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVIEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVDMLPGIQPGLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGCNMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIRGEISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGVASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 168 - protein, 2710 aa, Clostridium difficile; identical to SEQ ID NO: 92

SEQ ID NO: 169 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTINGKKYYFNTNTSIASTGYTIINGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 170 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 171 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 172 - protein, 2710 aa, Clostridium difficile; identical to SEQ ID NO: 171

SEQ ID NO: 173 - protein, 2366 aa, Clostridium difficile; identical to SEQ ID NO: 115

SEQ ID NO: 174 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVDMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGCNMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIRREISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 175 - protein, 2366 aa, Clostridium difficile; identical to SEQ ID NO: 174

SEQ ID NO: 176 - protein, 2366 aa, Clostridium difficile; identical to SEQ ID NO: 174

SEQ ID NO: 177 - protein, 2366 aa, Clostridium difficile; identical to SEQ ID NO: 174

SEQ ID NO: 178 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGNKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKGIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 179 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETEEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKYFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 180 - protein, 2710 aa, Clostridium difficile; identical to SEQ ID NO: 95

SEQ ID NO: 181 - protein, 2366 aa, Clostridium difficile; identical to SEQ ID NO: 116

SEQ ID NO: 182 - protein, 2367 aa, Clostridium difficile; identical to SEQ ID NO: 121

SEQ ID NO: 183 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIKYSSNKKVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 184 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIKYNSSKKSLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 185 - protein, 320 aa, Clostridium difficile
ASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 186 - protein, 611 aa, Clostridium difficile
ILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTA

SEQ ID NO: 187 - protein, 965 aa, Clostridium difficile
GWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 188 - protein, 965 aa, Clostridium difficile
GWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 189 - protein, 832 aa, Clostridium difficile
GWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 190 - protein, 1056 aa, Clostridium difficile
GWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 191 - protein, 970 aa, Clostridium difficile
GWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYGGGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 192 - protein, 1112 aa, Clostridium difficile
ATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYGGTGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISEHHHHHH

SEQ ID NO: 193 - protein, 1107 aa, Clostridium difficile
ATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAVTGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISEHHHHHH

SEQ ID NO: 194 - protein, 1128 aa, Clostridium difficile
ATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISEHHHHHH

SEQ ID NO: 195 - protein, 994 aa, Clostridium difficile
ATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAVKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISEHHHHHH

SEQ ID NO: 196 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNVKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 197 - protein, 2710 aa, Clostridium difficile; identical to SEQ ID NO: 15

SEQ ID NO: 198 - protein, 2710 aa, Clostridium difficile; identical to SEQ ID NO: 92

SEQ ID NO: 199 - protein, 2710 aa, Clostridium difficile; identical to SEQ ID NO: 15

SEQ ID NO: 200 - protein, 2710 aa, Clostridium difficile; identical to SEQ ID NO: 15

SEQ ID NO: 201 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKDSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNIKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGVISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVSGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 202 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKKSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGEKYYFDNNSKAVTGWQTIDSKKYYFNTNTAEAATGWQTIDGKKYYFNTNTAEVATGWQTIDGKKYYFNTNTSIASTGYTIINGKHFYFNTDGIMQIGVFKGPDGFEYFAPANTDANNIEGQAILYQNKFLTLNDKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 203 - protein, 2710 aa, Artificial Sequence
  Synthetic amino acid sequence
GSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 204 - protein, 2709 aa, Artificial Sequence
  Synthetic amino acid sequence
GSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 205 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 206 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 207 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINALWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 208 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 209 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVAMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENNGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 210 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 211 - protein, 718 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLL

SEQ ID NO: 212 - protein, 2709 aa, Artificial Sequence
  Synthetic amino acid sequence
  misc_feature (100)..(100): Xaa can be any naturally occurring amino acid
  VARIANT (101)..(101): Xaa is any amino acid, but not Trp
  VARIANT (286)..(286): Xaa is any amino acid, but not Asp
  VARIANT (513)..(513): Xaa is any amino acid, but not Glu
  VARIANT (518)..(518): Xaa is any amino acid, but not Trp
  VARIANT (699)..(699): Xaa is any amino acid, but not Cys
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVXIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVXMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQXINSLXSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGXNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 213 - protein, 2366 aa, Artificial Sequence
  Synthetic amino acid sequence
GSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 214 - protein, 2365 aa, Artificial Sequence
  Synthetic amino acid sequence
GSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 215 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 216 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 217 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMAALWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 218 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 219 - protein, 2365 aa, Artificial Sequence
  Synthetic amino acid sequence
SLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVAMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQQMASLWSFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEGRIEEAKSLTSDSINYIKNEFKLIESISDALYDLKQQNELEESHFISFEDILETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 220 - protein, 2365 aa, Artificial Sequence
  Synthetic amino acid sequence
SLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVAMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQQMASLASFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGANMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEGRIEEAKSLTSDSINYIKNEFKLIESISDALYDLKQQNELEESHFISFEDILETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 221 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 222 - protein, 2365 aa, Artificial Sequence
  Synthetic amino acid sequence
  VARIANT (101)..(101): Xaa is any amino acid, but not Trp
  VARIANT (287)..(287): Xaa is any amino acid, but not Asp
  VARIANT (514)..(514): Xaa is any amino acid, but not Glu
  VARIANT (519)..(519): Xaa is any amino acid, but not Trp
  VARIANT (697)..(697): Xaa is any amino acid, but not Cys
SLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVXIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVXMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQXMASLXSFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGXNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEGRIEEAKSLTSDSINYIKNEFKLIESISDALYDLKQQNELEESHFISFEDILETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 223 - protein, 769 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEA

SEQ ID NO: 224 - protein, 541 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 225 - protein, 228 aa, Clostridium difficile
LSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEA

SEQ ID NO: 226 - protein, 1039 aa, Clostridium difficile
IMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDR

SEQ ID NO: 227 - protein, 266 aa, Clostridium difficile
AEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSF

SEQ ID NO: 228 - protein, 902 aa, Clostridium difficile
DHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 229 - protein, 204 aa, Clostridium difficile
RYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLN

SEQ ID NO: 230 - protein, 457 aa, Clostridium difficile
ILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 231 - protein, 320 aa, Clostridium difficile
ASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 232 - protein, 864 aa, Clostridium difficile
FDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 233 - protein, 403 aa, Clostridium difficile
YQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 234 - protein, 872 aa, Clostridium difficile
SLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 235 - protein, 743 aa, Clostridium difficile
AVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 236 - protein, 816 aa, Clostridium difficile
MQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 237 - protein, 767 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEES

SEQ ID NO: 238 - protein, 543 aa, Clostridium difficile; identical to SEQ ID NO: 31

SEQ ID NO: 239 - protein, 224 aa, Clostridium difficile; identical to SEQ ID NO: 33

SEQ ID NO: 240 - protein, 1066 aa, Clostridium difficile
IIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVS

SEQ ID NO: 241 - protein, 514 aa, Clostridium difficile
ITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 242 - protein, 210 aa, Clostridium difficile
VQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 243 - protein, 311 aa, Clostridium difficile
YSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 244 - protein, 768 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVALAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEA

SEQ ID NO: 245 - protein, 540 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVALAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 246 - protein, 766 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMALAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGNKISYEAACNLFAKTPYDSVLFQKNIEDSEIAYYYNPGDGEIQEIDKYKIPSIISDRPKIKLTFIGAGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEES

SEQ ID NO: 247 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMALAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSL

SEQ ID NO: 248 - protein, 228 aa, Artificial Sequence
  Synthetic amino acid sequence
LSEDNGVDFNKNTALDKNYLLNNKIPSNNVEEAGSKNYVHYIIQLQGNDISYEATCNLFSKNPKNSIIIQRNMNESAKSYFLSDDGESILELNKYRIPERLKNKEKVKVTFIGAGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEA

SEQ ID NO: 249 - protein, 224 aa, Artificial Sequence
  Synthetic amino acid sequence
GEDDNLDFSQNIVVDKEYLLEKISSLARSSERGYIHYIVQLQGNKISYEAACNLFAKTPYDSVLFQKNIEDSEIAYYYNPGDGEIQEIDKYKIPSIISDRPKIKLTFIGAGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEES

SEQ ID NO: 250 - protein, 322 aa, Artificial Sequence
  Synthetic amino acid sequence
ASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPLE

SEQ ID NO: 251 - protein, 320 aa, Artificial Sequence
  Synthetic amino acid sequence
ASTGYTSINGKHFYFNTDGIMQIGVFKGPNGFEYFAPANTDNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 252 - protein, 320 aa, Artificial Sequence
  Synthetic amino acid sequence
ASTGYTSINGKHFYFNTDGIMQIGVFKGPNGFEYFAPANTHANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 253 - protein, 320 aa, Artificial Sequence; identical to SEQ ID NO: 185
  Synthetic amino acid sequence

SEQ ID NO: 254 - protein, 872 aa, Clostridium difficile
HMSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMALAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGSGGGGASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPLE

SEQ ID NO: 255 - protein, 206 aa, Artificial Sequence
  Synthetic amino acid sequence
RYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNLE

SEQ ID NO: 256 - protein, 865 aa, Artificial Sequence
  Synthetic amino acid sequence
DPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPLE

SEQ ID NO: 257 - protein, 459 aa, Artificial Sequence
  Synthetic amino acid sequence
ILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPLE

SEQ ID NO: 258 - protein, 888 aa, Artificial Sequence
  Synthetic amino acid sequence
GSSHHHHHHENLYFQGSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 259 - protein, 832 aa, Artificial Sequence
  Synthetic amino acid sequence
GSSHHHHHHENLYFQGMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 260 - protein, 759 aa, Artificial Sequence
  Synthetic amino acid sequence
GSSHHHHHHENLYFQGAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 261 - protein, 419 aa, Artificial Sequence
  Synthetic amino acid sequence
GSSHHHHHHENLYFQGYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 262 - protein, 244 aa, Artificial Sequence
  Synthetic amino acid sequence
GSSHHHHHHENLYFQGLSEDNGVDFNKNTALDKNYLLNNKIPSNNVEEAGSKNYVHYIIQLQGNDISYEATCNLFSKNPKNSIIIQRNMNESAKSYFLSDDGESILELNKYRIPERLKNKEKVKVTFIGAGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEA

SEQ ID NO: 263 - protein, 281 aa, Artificial Sequence
  Synthetic amino acid sequence
GSSHHHHHHENLYFQGEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSF

SEQ ID NO: 264 - protein, 240 aa, Artificial Sequence
  Synthetic amino acid sequence
GSSHHHHHHENLYFQGGEDDNLDFSQNIVVDKEYLLEKISSLARSSERGYIHYIVQLQGNKISYEAACNLFAKTPYDSVLFQKNIEDSEIAYYYNPGDGEIQEIDKYKIPSIISDRPKIKLTFIGAGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEES

SEQ ID NO: 265 - protein, 782 aa, Artificial Sequence
  Synthetic amino acid sequence
GSSHHHHHHENLYFQGSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMALAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGNKISYEAACNLFAKTPYDSVLFQKNIEDSEIAYYYNPGDGEIQEIDKYKIPSIISDRPKIKLTFIGAGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEES

SEQ ID NO: 266 - protein, 558 aa, Artificial Sequence
  Synthetic amino acid sequence
GSSHHHHHHENLYFQGSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMALAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSL

SEQ ID NO: 267 - protein, 532 aa, Artificial Sequence
  Synthetic amino acid sequence
GSSHHHHHHENLYFQGITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISELE

SEQ ID NO: 268 - protein, 228 aa, Artificial Sequence
  Synthetic amino acid sequence
GSSHHHHHHENLYFQGVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISELE

SEQ ID NO: 269 - protein, 304 aa, Artificial Sequence
  Synthetic amino acid sequence
GSSHHHHHHENLYFQGYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAAT

SEQ ID NO: 270 - protein, 360 aa, Artificial Sequence
  Synthetic amino acid sequence
RGSHHHHHHGMASMTGGQQMGRDLYDDDDKDRWGSSRITRASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 271 - protein, 329 aa, Artificial Sequence
  Synthetic amino acid sequence
  VARIANT (327)..(327): Xaa is any amino acid
ASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPTESTCRXQA

SEQ ID NO: 272 - protein, 369 aa, Artificial sequence
  Synthetic amino acid sequence
  VARIANT (367)..(367): Xaa is any amino acid.
  VARIANT (368)..(368): Xaa is any amino acid.
RGSHHHHHHGMASMTGGQQMGRDLYDDDDKDRWGSSRITRASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPTESTCRXQA

SEQ ID NO: 273 - protein, 360 aa, Artificial Sequence
  Synthetic amino acid sequence
RGSHHHHHHGMASMTGGQQMGRDLYDDDDKDRWGSSRITRASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 274 - protein, 329 aa, Artificial Sequence
  Synthetic amino acid sequence
  VARIANT (327)..(327): Xaa is any amino acid.
ASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPTESTCRXQA

SEQ ID NO: 275 - protein, 369 aa, Artificial Sequence
  Synthetic amino acid sequence
  VARIANT (367)..(367): Xaa is any amino acid
RGSHHHHHHGMASMTGGQQMGRDLYDDDDKDRWGSSRITRASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPTESTCRXQA

SEQ ID NO: 276 - protein, 2710 aa, Artificial Sequence
  Synthetic amino acid sequence
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVAMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENNGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 277 - protein, 2710 aa, Artificial Sequence
  Synthetic amino acid sequence
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 278 - protein, 2710 aa, Artificial Sequence; identical to SEQ ID NO: 276
  Synthetic amino acid sequence

SEQ ID NO: 279 - protein, 2710 aa, Artificial Sequence; identical to SEQ ID NO: 277
  Synthetic amino acid sequence

SEQ ID NO: 280 - protein, 2710 aa, Artificial Sequence; identical to SEQ ID NO: 277
  Synthetic amino acid sequence

SEQ ID NO: 281 - protein, 2710 aa, Artificial Sequence
  Synthetic amino acid sequence
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDVNTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 282 - protein, 2710 aa, Artificial Sequence
  Synthetic amino acid sequence
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEVATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAETATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 283 - protein, 2710 aa, Artificial Sequence; identical to SEQ ID NO: 281
  Synthetic amino acid sequence

SEQ ID NO: 284 - protein, 2710 aa, Artificial Sequence
  Synthetic amino acid sequence
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEVATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 285 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVAMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENNGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 286 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTYNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 287 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 288 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEVATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 289 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMKIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTYNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 290 - protein, 2709 aa, Artificial Sequence; identical to SEQ ID NO: 288
  Synthetic amino acid sequence

SEQ ID NO: 291 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNTKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTLSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTDANNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGNIYYFGNNSKAVTGWQTINGKVYYFMPDTAMAAAGGLFEIDGVIYFFGVDGVKAPGIYG

SEQ ID NO: 292 - protein, 2709 aa, Artificial Sequence; identical to SEQ ID NO: 291
  Synthetic amino acid sequence

SEQ ID NO: 293 - protein, 2709 aa, Artificial Sequence; identical to SEQ ID NO: 291
  Synthetic amino acid sequence

SEQ ID NO: 294 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 295 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDVNTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 296 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 297 - protein, 2709 aa, Artificial Sequence; identical to SEQ ID NO: 294
  Synthetic amino acid sequence

SEQ ID NO: 298 - protein, 2709 aa, Artificial Sequence; identical to SEQ ID NO: 285
  Synthetic amino acid sequence

SEQ ID NO: 299 - protein, 2709 aa, Artificial Sequence; identical to SEQ ID NO: 294
  Synthetic amino acid sequence

SEQ ID NO: 300 - protein, 2709 aa, Artificial Sequence; identical to SEQ ID NO: 294
  Synthetic amino acid sequence

SEQ ID NO: 301 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTYNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 302 - protein, 2708 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQGLLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 303 - protein, 2708 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 304 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 305 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGNKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKGIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 306 - protein, 2709 aa, Artificial Sequence; identical to SEQ ID NO: 305
  Synthetic amino acid sequence

SEQ ID NO: 307 - protein, 2709 aa, Artificial Sequence; identical to SEQ ID NO: 294
  Synthetic amino acid sequence

SEQ ID NO: 308 - protein, 2709 aa, Artificial Sequence; identical to SEQ ID NO: 286
  Synthetic amino acid sequence

SEQ ID NO: 309 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPNTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 310 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDVNTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 311 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGNKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKGIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 312 - protein, 2709 aa, Artificial Sequence; identical to SEQ ID NO: 287
  Synthetic amino acid sequence

SEQ ID NO: 313 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFASDSKAVTGLRTIDGKKYYFNTNTAVAATGWQTINGKKYYFNTNTSIASTGYTIINGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 314 - protein, 2709 aa, Artificial Sequence; identical to SEQ ID NO: 294
  Synthetic amino acid sequence

SEQ ID NO: 315 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFASDSKAVTGLRTIDGKKYYFNTNTAEAATGWQTINGKKYYFNTNTSIASTGYTIINGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 316 - protein, 2709 aa, Artificial Sequence; identical to SEQ ID NO: 287
  Synthetic amino acid sequence

SEQ ID NO: 317 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFASDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIEGQAIRYQNRFLHLLGNIYYFGNNSKAVTGWQTINGNMYYFMPDTAMAAAGGLFEIDGVIYFFGVDGVKAPGIYG

SEQ ID NO: 318 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFASDSKAVTGLRTIDGKKYYFNTNTAVAVTGWQTINGKKYYFNTNTSIASTGYTIINGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 319 - protein, 2709 aa, Artificial Sequence; identical to SEQ ID NO: 288
  Synthetic amino acid sequence

SEQ ID NO: 320 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQGLLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 321 - protein, 2709 aa, Artificial Sequence; identical to SEQ ID NO: 318
  Synthetic amino acid sequence

SEQ ID NO: 322 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYENTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTSIASTGYTSINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 323 - protein, 2709 aa, Artificial Sequence; identical to SEQ ID NO: 210
  Synthetic amino acid sequence

SEQ ID NO: 324 - protein, 2365 aa, Artificial Sequence
  Synthetic amino acid sequence
SLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVAMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEHQMASLASFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGANMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEGRIEEAKSLTSDSINYIKNEFKLIESISDALYDLKQQNELEESHFISFEDILETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 325 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEHQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 326 - protein, 2365 aa, Artificial Sequence; identical to SEQ ID NO: 324
  Synthetic amino acid sequence

SEQ ID NO: 327 - protein, 2365 aa, Artificial Sequence; identical to SEQ ID NO: 325
  Synthetic amino acid sequence

SEQ ID NO: 328 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEHQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYRFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 329 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEHQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 330 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVAMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQQMASLATFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGANMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIEREISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 331 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 332 - protein, 2365 aa, Artificial Sequence; identical to SEQ ID NO: 330
  Synthetic amino acid sequence

SEQ ID NO: 333 - protein, 2365 aa, Artificial Sequence; identical to SEQ ID NO: 220
  Synthetic amino acid sequence

SEQ ID NO: 334 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTDYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 335 - protein, 2366 aa, Artificial Sequence
  Synthetic amino acid sequence
SLVNRKQLEKMANVRFRVQEDEYVAILDALEEYHNMSENTVVEKYLKLKDINSLTDTYIDTYKKSGRNKALKKFKEYLVIEILELKNSNLTPVEKNLHFIAIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVAMLPGIHPDLFKDINKPDSVKTAVDWEEMQLEAIMKHKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQQKNSLAQFNEERAKIQFEEYKKNYFEGALGEDDNLDFSQNTVTDKEYLLEKISSSTKSSERGYVHYIVQLQGDKISYEAACNLFAKNPYDSILFQKNIEDSEVAYYYNPTDSEIQEIDKYRIPDRISDRPKIKLTFIGHGKAEFNTDIFAGLDVDSLSSEIETAIGLAKEDISPKSIEINLLGANMFSYSVNVEETYPGKLLLRVKDKVSELMPSMSQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKVMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENNNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFDPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 336 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 337 - protein, 2365 aa, Artificial Sequence; identical to SEQ ID NO: 330
  Synthetic amino acid sequence

SEQ ID NO: 338 - protein, 2365 aa, Artificial Sequence; identical to SEQ ID NO: 331
  Synthetic amino acid sequence

SEQ ID NO: 339 - protein, 2365 aa, Artificial Sequence; identical to SEQ ID NO: 330
  Synthetic amino acid sequence

SEQ ID NO: 340 - protein, 2366 aa, Artificial Sequence
  Synthetic amino acid sequence
SLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIAIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVAMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQQKNSLAQFNEERAKIQFEEYKKNYFEGALGEDDNLDFSQNTVIDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGANMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALYDLKQQNELEESHFISFEDISETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSSPSITYREPHLSIYDVLEVKKEELDLSKDLMVLPNAPNRVFGWETGWTPGLRGLENDGTKLLDRIRDQYEGQFYWRFFAFIADALITTLKPRYEDTNVRISLDSNTRSFIVPVITTEYIREKLSYSFYGSGGTYALSLSQYNMNINIELNENDTWVIDVDNVVRSVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLIIKVYMDNSKPPFGYYSNDLKDVKAITKDDVIILTGYYLKDDIKISLSFTIQDKNTIKLNGVYLDENGVAEILKFMNKKGSTNTSDSLMSFLESMNIKSIFIKSLKSNAKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYHLGLISLYNEKFYINNFGMMVSGLVYINDSLYYFKPPIKNLITGFTTIGDDKYYFNPDNGGAASVGETIIDGKNYYFSPNGVLQTGVFSTEDGFKYFAPADTLDENLEGEAIDFTGKLIIDENVYYFGDNYRAAIEWQTLDDEVYYFSTDTGRAFKGLNQIGDDKFYFNSDGIMQKGFVNINDKTFYFDDSGVMKSGYTEIDGKHFYFAENGEMQIGVFNTADGFKYFAHHDEDLGNEEGEALSYSGILNFNNKIYYFDDSFTAVVGWKDSEDGSKYYFDEDTAEAYIGISTINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYINIEDKMFYFNEDGVMQIGVFNTADGFKYFAHQNTLDENFEGESINYTGWLDLDEKRYYFTDEYIAAIGSVIIDGEEYYFDPDTAELVISE

SEQ ID NO: 341 - protein, 2366 aa, Artificial Sequence; identical to SEQ ID NO: 340
  Synthetic amino acid sequence

SEQ ID NO: 342 - protein, 2366 aa, Artificial Sequence
  Synthetic amino acid sequence
SLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIAIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVAMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQQKNSLAQFNEERAKIQFEEYKKNYFEGALGEDDNLDFSQNTVIDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGANMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALYDLKQQNELEESHFISFEDISETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSSPSITYREPHLSIYDVLEVKKEELDLSKDLMVLPNAPNRVFGWETGWTPGLRGLENDGTKLLDRIRDQYEGQFYWRFFAFIADALITTLKPRYEDTNVRISLDSNTRSFIVPVITTEYIREKLSYSFYGSGGTYALSLSQYNMNINIELNENDTWVIDVDNVVRSVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKDGLFVSELSDVVLIIKVYMDNSKPPFGYYSNDLKDVKAITKDDVIILTGYYLKDDIKISLSFTIQDKNTIKLNGVYLDENGVAEILKFMNKKGSTNTSDSLMSFLESMNIKSIFIKSLKSNAKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYHLGLISLYNEKFYINNFGMMVSGLVYINDSLYYFKPPIKNLITGFTTIGDDKYYFNPDNGGAASVGETIIDGKNYYFSPNGVLQTGVFSTEDGFKYFAPADTLDENLEGEAIDFTGKLIIDENVYYFGDNYRAAIEWQTLDDEVYYFSTDTGRAFKGLNQIGDDKFYFNSDGIMQKGFVNINDKTFYFDDSGVMKSGYTEIDGKHFYFAENGEMQIGVFNTADGFKYFAHHDEDLGNEEGEALSYSGILNFNNKIYYFDDSFTAVVGWKDSEDGSKYYFDEDTAEAYIGISTINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYINIEDKMFYFNEDGVMQIGVFNTADGFKYFAHQNTLDENFEGESINYTGWLDLDEKRYYFTDEYIAAIGSVIIDGEEYYFDPDTAELVISE

SEQ ID NO: 343 - protein, 2365 aa, Artificial Sequence; identical to SEQ ID NO: 336
  Synthetic amino acid sequence

SEQ ID NO: 344 - protein, 2365 aa, Artificial Sequence; identical to SEQ ID NO: 331
  Synthetic amino acid sequence

SEQ ID NO: 345 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMLSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 346 - protein, 2365 aa, Artificial Sequence; identical to SEQ ID NO: 336
  Synthetic amino acid sequence

SEQ ID NO: 347 - protein, 2365 aa, Artificial Sequence; identical to SEQ ID NO: 220
  Synthetic amino acid sequence

SEQ ID NO: 348 - protein, 2365 aa, Artificial Sequence; identical to SEQ ID NO: 336
  Synthetic amino acid sequence

SEQ ID NO: 349 - protein, 2365 aa, Artificial Sequence; identical to SEQ ID NO: 336
  Synthetic amino acid sequence

SEQ ID NO: 350 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPGLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 351 - protein, 2365 aa, Artificial Sequence; identical to SEQ ID NO: 350
  Synthetic amino acid sequence

SEQ ID NO: 352 - protein, 2365 aa, Artificial Sequence; identical to SEQ ID NO: 336
  Synthetic amino acid sequence

SEQ ID NO: 353 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 354 - protein, 2366 aa, Artificial Sequence; identical to SEQ ID NO: 335
  Synthetic amino acid sequence

SEQ ID NO: 355 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLASFDDSRAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 356 - protein, 2365 aa, Artificial Sequence; identical to SEQ ID NO: 355
  Synthetic amino acid sequence

SEQ ID NO: 357 - protein, 2365 aa, Artificial Sequence; identical to SEQ ID NO: 355
  Synthetic amino acid sequence

SEQ ID NO: 358 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQQMASLASFDDSRAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 359 - protein, 2365 aa, Artificial Sequence; identical to SEQ ID NO: 358
  Synthetic amino acid sequence

SEQ ID NO: 360 - protein, 2365 aa, Artificial Sequence; identical to SEQ ID NO: 331
  Synthetic amino acid sequence

SEQ ID NO: 361 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETEEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKYFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 362 - protein, 2365 aa, Artificial Sequence; identical to SEQ ID NO: 350
  Synthetic amino acid sequence

SEQ ID NO: 363 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVAMLPGIQPGLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQQMASLATFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGANMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIRGEISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGVASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 364 - protein, 2365 aa, Artificial Sequence; identical to SEQ ID NO: 363
  Synthetic amino acid sequence

SEQ ID NO: 365 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVAMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQQMASLATFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGANMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIRREISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 366 - protein, 2365 aa, Artificial Sequence; identical to SEQ ID NO: 363
  Synthetic amino acid sequence

SEQ ID NO: 367 - protein, 2365 aa, Artificial Sequence; identical to SEQ ID NO: 365
  Synthetic amino acid sequence

SEQ ID NO: 368 - protein, 2365 aa, Artificial Sequence; identical to SEQ ID NO: 365
  Synthetic amino acid sequence

SEQ ID NO: 369 - protein, 2365 aa, Artificial Sequence; identical to SEQ ID NO: 330
  Synthetic amino acid sequence

SEQ ID NO: 370 - protein, 2365 aa, Artificial Sequence; identical to SEQ ID NO: 363
  Synthetic amino acid sequence

SEQ ID NO: 371 - protein, 2365 aa, Artificial Sequence; identical to SEQ ID NO: 365
  Synthetic amino acid sequence

SEQ ID NO: 372 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVIEVLELKNNNLTPVEKNLHFVAIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVAMLPGIQPGLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQQMASLATFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGANMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIRGEISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGVASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 373 - protein, 2365 aa, Artificial Sequence; identical to SEQ ID NO: 221
  Synthetic amino acid sequence

SEQ ID NO: 374 - protein, 321 aa, Artificial Sequence
  Synthetic amino acid sequence
IASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAP

SEQ ID NO: 375 - protein, 321 aa, Artificial Sequence
  Synthetic amino acid sequence
IASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 376 - protein, 321 aa, Artificial Sequence; identical to SEQ ID NO: 374
  Synthetic amino acid sequence

SEQ ID NO: 377 - protein, 321 aa, Artificial Sequence; identical to SEQ ID NO: 375
  Synthetic amino acid sequence

SEQ ID NO: 378 - protein, 321 aa, Artificial Sequence; identical to SEQ ID NO: 375
  Synthetic amino acid sequence

SEQ ID NO: 379 - protein, 321 aa, Artificial Sequence
  Synthetic amino acid sequence
IASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 380 - protein, 321 aa, Artificial Sequence
  Synthetic amino acid sequence
IASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAP

SEQ ID NO: 381 - protein, 321 aa, Artificial Sequence; identical to SEQ ID NO: 379
  Synthetic amino acid sequence

SEQ ID NO: 382 - protein, 321 aa, Artificial Sequence; identical to SEQ ID NO: 380
  Synthetic amino acid sequence

SEQ ID NO: 383 - protein, 321 aa, Artificial Sequence; identical to SEQ ID NO: 374
  Synthetic amino acid sequence

SEQ ID NO: 384 - protein, 321 aa, Artificial Sequence; identical to SEQ ID NO: 375
  Synthetic amino acid sequence

SEQ ID NO: 385 - protein, 321 aa, Artificial Sequence; identical to SEQ ID NO: 375
  Synthetic amino acid sequence

SEQ ID NO: 386 - protein, 321 aa, Artificial Sequence; identical to SEQ ID NO: 380
  Synthetic amino acid sequence

SEQ ID NO: 387 - protein, 321 aa, Artificial Sequence; identical to SEQ ID NO: 375
  Synthetic amino acid sequence

SEQ ID NO: 388 - protein, 321 aa, Artificial Sequence; identical to SEQ ID NO: 380
  Synthetic amino acid sequence

SEQ ID NO: 389 - protein, 321 aa, Artificial Sequence
  Synthetic amino acid sequence
IASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGNIYYFGNNSKAVTGWQTINGKVYYFMPDTAMAAAGGLFEIDGVIYFFGVDGVKAP

SEQ ID NO: 390 - protein, 321 aa, Artificial Sequence; identical to SEQ ID NO: 389
  Synthetic amino acid sequence

SEQ ID NO: 391 - protein, 321 aa, Artificial Sequence; identical to SEQ ID NO: 389
  Synthetic amino acid sequence

SEQ ID NO: 392 - protein, 321 aa, Artificial Sequence; identical to SEQ ID NO: 375
  Synthetic amino acid sequence

SEQ ID NO: 393 - protein, 321 aa, Artificial Sequence; identical to SEQ ID NO: 379
  Synthetic amino acid sequence

SEQ ID NO: 394 - protein, 321 aa, Artificial Sequence; identical to SEQ ID NO: 379
  Synthetic amino acid sequence

SEQ ID NO: 395 - protein, 321 aa, Artificial Sequence; identical to SEQ ID NO: 375
  Synthetic amino acid sequence

SEQ ID NO: 396 - protein, 321 aa, Artificial Sequence; identical to SEQ ID NO: 374
  Synthetic amino acid sequence

SEQ ID NO: 397 - protein, 321 aa, Artificial Sequence; identical to SEQ ID NO: 375
  Synthetic amino acid sequence

SEQ ID NO: 398 - protein, 321 aa, Artificial Sequence; identical to SEQ ID NO: 375
  Synthetic amino acid sequence

SEQ ID NO: 399 - protein, 321 aa, Artificial Sequence; identical to SEQ ID NO: 375
  Synthetic amino acid sequence

SEQ ID NO: 400 - protein, 321 aa, Artificial Sequence; identical to SEQ ID NO: 375
  Synthetic amino acid sequence

SEQ ID NO: 401 - protein, 321 aa, Artificial Sequence; identical to SEQ ID NO: 375
  Synthetic amino acid sequence

SEQ ID NO: 402 - protein, 321 aa, Artificial Sequence; identical to SEQ ID NO: 379
  Synthetic amino acid sequence

SEQ ID NO: 403 - protein, 321 aa, Artificial Sequence; identical to SEQ ID NO: 375
  Synthetic amino acid sequence

SEQ ID NO: 404 - protein, 321 aa, Artificial Sequence; identical to SEQ ID NO: 375
  Synthetic amino acid sequence

SEQ ID NO: 405 - protein, 321 aa, Artificial Sequence; identical to SEQ ID NO: 375
  Synthetic amino acid sequence

SEQ ID NO: 406 - protein, 321 aa, Artificial Sequence; identical to SEQ ID NO: 375
  Synthetic amino acid sequence

SEQ ID NO: 407 - protein, 321 aa, Artificial Sequence; identical to SEQ ID NO: 379
  Synthetic amino acid sequence

SEQ ID NO: 408 - protein, 321 aa, Artificial Sequence; identical to SEQ ID NO: 375
  Synthetic amino acid sequence

SEQ ID NO: 409 - protein, 321 aa, Artificial Sequence; identical to SEQ ID NO: 375
  Synthetic amino acid sequence

SEQ ID NO: 410 - protein, 321 aa, Artificial Sequence; identical to SEQ ID NO: 375
  Synthetic amino acid sequence

SEQ ID NO: 411 - protein, 321 aa, Artificial Sequence
  Synthetic amino acid sequence
IASTGYTSINGKHFYFNTDGIMQIGVFKGPNGFEYFAPANTHNNNIEGQAILYQNKFLTLNGKKYYFASDSKAVTGLRTIDGKKYYFNTNTAVAATGWQTINGKKYYFNTNTSIASTGYTIINGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAP

SEQ ID NO: 412 - protein, 321 aa, Artificial Sequence; identical to SEQ ID NO: 375
  Synthetic amino acid sequence

SEQ ID NO: 413 - protein, 321 aa, Artificial Sequence
  Synthetic amino acid sequence
IASTGYTSINGKHFYFNTDGIMQIGVFKGPNGFEYFAPANTHNNNIEGQAILYQNKFLTLNGKKYYFASDSKAVTGLRTIDGKKYYFNTNTAEAATGWQTINGKKYYFNTNTSIASTGYTIINGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAP

SEQ ID NO: 414 - protein, 321 aa, Artificial Sequence; identical to SEQ ID NO: 375
  Synthetic amino acid sequence

SEQ ID NO: 415 - protein, 321 aa, Artificial Sequence
  Synthetic amino acid sequence
IASTGYTSINGKHFYFNTDGIMQIGVFKGPNGFEYFAPANTHNNNIEGQAILYQNKFLTLNGKKYYFASDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIEGQAIRYQNRFLHLLGNIYYFGNNSKAVTGWQTINGNMYYFMPDTAMAAAGGLFEIDGVIYFFGVDGVKAP

SEQ ID NO: 416 - protein, 321 aa, Artificial Sequence
  Synthetic amino acid sequence
IASTGYTSINGKHFYFNTDGIMQIGVFKGPNGFEYFAPANTHNNNIEGQAILYQNKFLTLNGKKYYFASDSKAVTGLRTIDGKKYYFNTNTAVAVTGWQTINGKKYYFNTNTSIASTGYTIINGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAP

SEQ ID NO: 417 - protein, 321 aa, Artificial Sequence; identical to SEQ ID NO: 380
  Synthetic amino acid sequence

SEQ ID NO: 418 - protein, 321 aa, Artificial Sequence; identical to SEQ ID NO: 375
  Synthetic amino acid sequence

SEQ ID NO: 419 - protein, 321 aa, Artificial Sequence; identical to SEQ ID NO: 416
  Synthetic amino acid sequence

SEQ ID NO: 420 - protein, 321 aa, Artificial Sequence; identical to SEQ ID NO: 375
  Synthetic amino acid sequence

SEQ ID NO: 421 - protein, 321 aa, Artificial Sequence; identical to SEQ ID NO: 379
  Synthetic amino acid sequence

SEQ ID NO: 422 - protein, 612 aa, Artificial Sequence
  Synthetic amino acid sequence
FILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTA

SEQ ID NO: 423 - protein, 612 aa, Artificial Sequence
  Synthetic amino acid sequence
FILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTA

SEQ ID NO: 424 - protein, 612 aa, Artificial Sequence; identical to SEQ ID NO: 422
  Synthetic amino acid sequence

SEQ ID NO: 425 - protein, 612 aa, Artificial Sequence; identical to SEQ ID NO: 423
  Synthetic amino acid sequence

SEQ ID NO: 426 - protein, 612 aa, Artificial Sequence
  Synthetic amino acid sequence
FILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTA

SEQ ID NO: 427 - protein, 612 aa, Artificial Sequence; identical to SEQ ID NO: 426
  Synthetic amino acid sequence

SEQ ID NO: 428 - protein, 612 aa, Artificial Sequence
  Synthetic amino acid sequence
FILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTA

SEQ ID NO: 429 - protein, 612 aa, Artificial Sequence; identical to SEQ ID NO: 426
  Synthetic amino acid sequence

SEQ ID NO: 430 - protein, 612 aa, Artificial Sequence; identical to SEQ ID NO: 428
  Synthetic amino acid sequence

SEQ ID NO: 431 - protein, 612 aa, Artificial Sequence; identical to SEQ ID NO: 422
  Synthetic amino acid sequence

SEQ ID NO: 432 - protein, 612 aa, Artificial Sequence; identical to SEQ ID NO: 423
  Synthetic amino acid sequence

SEQ ID NO: 433 - protein, 612 aa, Artificial Sequence
  Synthetic amino acid sequence
FILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFDPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTA

SEQ ID NO: 434 - protein, 612 aa, Artificial Sequence; identical to SEQ ID NO: 423
  Synthetic amino acid sequence

SEQ ID NO: 435 - protein, 612 aa, Artificial Sequence; identical to SEQ ID NO: 428
  Synthetic amino acid sequence

SEQ ID NO: 436 - protein, 612 aa, Artificial Sequence; identical to SEQ ID NO: 426
  Synthetic amino acid sequence

SEQ ID NO: 437 - protein, 612 aa, Artificial Sequence; identical to SEQ ID NO: 428
  Synthetic amino acid sequence

SEQ ID NO: 438 - protein, 612 aa, Artificial Sequence
  Synthetic amino acid sequence
FILMSTDEENKVSQVKIRFTNVFKGNTISDKISFNFSDKQDVSINKIISTFTPSYYVEGLLNYHLGLISLYNEKFYINNFGMMVSGLVYINDSLYYFKPPIKNLITGFTTIGDDKYYFNPDNGGAASVGETIIDGKNYYFSPNGVLQTGVFSTEDGFKYFAPADTLDENLEGEAIDFTGKLIIDENVYYFGDNYRAAIEWQTLDDEVYYFSTDTGRAFKGLNQIGDDKFYFNSDGIMQKGFVNINDKTFYFDDSGVMKSGYTEIDGKHFYFAENGEMQIGVFNTADGFKYFAHHDEDLGNEEGEALSYSGILNFNNKIYYFDDSFTAVVGWKDSEDGSKYYFDEDTAEAYIGISTINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYINIEDKMFYFNEDGVMQIGVFNTADGFKYFAHQNTLDENFEGESINYTGWLDLDEKRYYFTDEYIAAIGSVIIDGEEYYFDPDTA

SEQ ID NO: 439 - protein, 612 aa, Artificial Sequence; identical to SEQ ID NO: 438
  Synthetic amino acid sequence

SEQ ID NO: 440 - protein, 612 aa, Artificial Sequence; identical to SEQ ID NO: 438
  Synthetic amino acid sequence

SEQ ID NO: 441 - protein, 612 aa, Artificial Sequence; identical to SEQ ID NO: 423
  Synthetic amino acid sequence

SEQ ID NO: 442 - protein, 612 aa, Artificial Sequence; identical to SEQ ID NO: 426
  Synthetic amino acid sequence

SEQ ID NO: 443 - protein, 612 aa, Artificial Sequence
  Synthetic amino acid sequence
FILMSTSEENKVSQVKIRFVNVFKDKTLANKLSFNFSDKQDVPVSEIILSFTPSYYEDGLIGYDLGLVSLYNEKFYINNFGMMLSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTA

SEQ ID NO: 444 - protein, 612 aa, Artificial Sequence; identical to SEQ ID NO: 423
  Synthetic amino acid sequence

SEQ ID NO: 445 - protein, 612 aa, Artificial Sequence; identical to SEQ ID NO: 422
  Synthetic amino acid sequence

SEQ ID NO: 446 - protein, 612 aa, Artificial Sequence; identical to SEQ ID NO: 423
  Synthetic amino acid sequence

SEQ ID NO: 447 - protein, 612 aa, Artificial Sequence; identical to SEQ ID NO: 423
  Synthetic amino acid sequence

SEQ ID NO: 448 - protein, 612 aa, Artificial Sequence; identical to SEQ ID NO: 423
  Synthetic amino acid sequence

SEQ ID NO: 449 - protein, 612 aa, Artificial Sequence; identical to SEQ ID NO: 423
  Synthetic amino acid sequence

SEQ ID NO: 450 - protein, 612 aa, Artificial Sequence; identical to SEQ ID NO: 423
  Synthetic amino acid sequence

SEQ ID NO: 451 - protein, 612 aa, Artificial Sequence; identical to SEQ ID NO: 426
  Synthetic amino acid sequence

SEQ ID NO: 452 - protein, 612 aa, Artificial Sequence; identical to SEQ ID NO: 433
  Synthetic amino acid sequence

SEQ ID NO: 453 - protein, 612 aa, Artificial Sequence; identical to SEQ ID NO: 426
  Synthetic amino acid sequence

SEQ ID NO: 454 - protein, 612 aa, Artificial Sequence; identical to SEQ ID NO: 426
  Synthetic amino acid sequence

SEQ ID NO: 455 - protein, 612 aa, Artificial Sequence; identical to SEQ ID NO: 426
  Synthetic amino acid sequence

SEQ ID NO: 456 - protein, 612 aa, Artificial Sequence; identical to SEQ ID NO: 426
  Synthetic amino acid sequence

SEQ ID NO: 457 - protein, 612 aa, Artificial Sequence; identical to SEQ ID NO: 426
  Synthetic amino acid sequence

SEQ ID NO: 458 - protein, 612 aa, Artificial Sequence; identical to SEQ ID NO: 426
  Synthetic amino acid sequence

SEQ ID NO: 459 - protein, 612 aa, Artificial Sequence
  Synthetic amino acid sequence
FILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKYFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTA

SEQ ID NO: 460 - protein, 612 aa, Artificial Sequence; identical to SEQ ID NO: 423
  Synthetic amino acid sequence

SEQ ID NO: 461 - protein, 612 aa, Artificial Sequence; identical to SEQ ID NO: 428
  Synthetic amino acid sequence

SEQ ID NO: 462 - protein, 612 aa, Artificial Sequence; identical to SEQ ID NO: 428
  Synthetic amino acid sequence

SEQ ID NO: 463 - protein, 612 aa, Artificial Sequence; identical to SEQ ID NO: 428
  Synthetic amino acid sequence

SEQ ID NO: 464 - protein, 612 aa, Artificial Sequence; identical to SEQ ID NO: 428
  Synthetic amino acid sequence

SEQ ID NO: 465 - protein, 612 aa, Artificial Sequence; identical to SEQ ID NO: 428
  Synthetic amino acid sequence

SEQ ID NO: 466 - protein, 612 aa, Artificial Sequence; identical to SEQ ID NO: 428
  Synthetic amino acid sequence

SEQ ID NO: 467 - protein, 612 aa, Artificial Sequence; identical to SEQ ID NO: 428
  Synthetic amino acid sequence

SEQ ID NO: 468 - protein, 612 aa, Artificial Sequence; identical to SEQ ID NO: 428
  Synthetic amino acid sequence

SEQ ID NO: 469 - protein, 612 aa, Artificial Sequence; identical to SEQ ID NO: 428
  Synthetic amino acid sequence

SEQ ID NO: 470 - protein, 612 aa, Artificial Sequence; identical to SEQ ID NO: 428
  Synthetic amino acid sequence

SEQ ID NO: 471 - protein, 612 aa, Artificial Sequence; identical to SEQ ID NO: 423
  Synthetic amino acid sequence

SEQ ID NO: 472 - protein, 540 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 473 - protein, 540 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 474 - protein, 540 aa, Artificial Sequence; identical to SEQ ID NO: 472
  Synthetic amino acid sequence

SEQ ID NO: 475 - protein, 540 aa, Artificial Sequence; identical to SEQ ID NO: 473
  Synthetic amino acid sequence

SEQ ID NO: 476 - protein, 540 aa, Artificial Sequence; identical to SEQ ID NO: 473
  Synthetic amino acid sequence

SEQ ID NO: 477 - protein, 540 aa, Artificial Sequence; identical to SEQ ID NO: 473
  Synthetic amino acid sequence

SEQ ID NO: 478 - protein, 540 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 479 - protein, 540 aa, Artificial Sequence; identical to SEQ ID NO: 473
  Synthetic amino acid sequence

SEQ ID NO: 480 - protein, 540 aa, Artificial Sequence; identical to SEQ ID NO: 478
  Synthetic amino acid sequence

SEQ ID NO: 481 - protein, 540 aa, Artificial Sequence; identical to SEQ ID NO: 472
  Synthetic amino acid sequence

SEQ ID NO: 482 - protein, 540 aa, Artificial Sequence; identical to SEQ ID NO: 473
  Synthetic amino acid sequence

SEQ ID NO: 483 - protein, 540 aa, Artificial Sequence; identical to SEQ ID NO: 473
  Synthetic amino acid sequence

SEQ ID NO: 484 - protein, 540 aa, Artificial Sequence; identical to SEQ ID NO: 478
  Synthetic amino acid sequence

SEQ ID NO: 485 - protein, 540 aa, Artificial Sequence; identical to SEQ ID NO: 473
  Synthetic amino acid sequence

SEQ ID NO: 486 - protein, 540 aa, Artificial Sequence; identical to SEQ ID NO: 478
  Synthetic amino acid sequence

SEQ ID NO: 487 - protein, 540 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNTKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 488 - protein, 540 aa, Artificial Sequence; identical to SEQ ID NO: 487
  Synthetic amino acid sequence

SEQ ID NO: 489 - protein, 540 aa, Artificial Sequence; identical to SEQ ID NO: 487
  Synthetic amino acid sequence

SEQ ID NO: 490 - protein, 540 aa, Artificial Sequence; identical to SEQ ID NO: 473
  Synthetic amino acid sequence

SEQ ID NO: 491 - protein, 540 aa, Artificial Sequence; identical to SEQ ID NO: 473
  Synthetic amino acid sequence

SEQ ID NO: 492 - protein, 540 aa, Artificial Sequence; identical to SEQ ID NO: 473
  Synthetic amino acid sequence

SEQ ID NO: 493 - protein, 540 aa, Artificial Sequence; identical to SEQ ID NO: 473
  Synthetic amino acid sequence

SEQ ID NO: 494 - protein, 540 aa, Artificial Sequence; identical to SEQ ID NO: 472
  Synthetic amino acid sequence

SEQ ID NO: 495 - protein, 540 aa, Artificial Sequence; identical to SEQ ID NO: 473
  Synthetic amino acid sequence

SEQ ID NO: 496 - protein, 540 aa, Artificial Sequence; identical to SEQ ID NO: 473
  Synthetic amino acid sequence

SEQ ID NO: 497 - protein, 540 aa, Artificial Sequence; identical to SEQ ID NO: 473
  Synthetic amino acid sequence

SEQ ID NO: 498 - protein, 540 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQGLLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 499 - protein, 540 aa, Artificial Sequence; identical to SEQ ID NO: 473
  Synthetic amino acid sequence

SEQ ID NO: 500 - protein, 540 aa, Artificial Sequence; identical to SEQ ID NO: 473
  Synthetic amino acid sequence

SEQ ID NO: 501 - protein, 540 aa, Artificial Sequence; identical to SEQ ID NO: 473
  Synthetic amino acid sequence

SEQ ID NO: 502 - protein, 540 aa, Artificial Sequence; identical to SEQ ID NO: 473
  Synthetic amino acid sequence

SEQ ID NO: 503 - protein, 540 aa, Artificial Sequence; identical to SEQ ID NO: 473
  Synthetic amino acid sequence

SEQ ID NO: 504 - protein, 540 aa, Artificial Sequence; identical to SEQ ID NO: 473
  Synthetic amino acid sequence

SEQ ID NO: 505 - protein, 540 aa, Artificial Sequence; identical to SEQ ID NO: 473
  Synthetic amino acid sequence

SEQ ID NO: 506 - protein, 540 aa, Artificial Sequence; identical to SEQ ID NO: 473
  Synthetic amino acid sequence

SEQ ID NO: 507 - protein, 540 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 508 - protein, 540 aa, Artificial Sequence; identical to SEQ ID NO: 473
  Synthetic amino acid sequence

SEQ ID NO: 509 - protein, 540 aa, Artificial Sequence; identical to SEQ ID NO: 478
  Synthetic amino acid sequence

SEQ ID NO: 510 - protein, 540 aa, Artificial Sequence; identical to SEQ ID NO: 473
  Synthetic amino acid sequence

SEQ ID NO: 511 - protein, 540 aa, Artificial Sequence; identical to SEQ ID NO: 478
  Synthetic amino acid sequence

SEQ ID NO: 512 - protein, 540 aa, Artificial Sequence; identical to SEQ ID NO: 473
  Synthetic amino acid sequence

SEQ ID NO: 513 - protein, 540 aa, Artificial Sequence; identical to SEQ ID NO: 478
  Synthetic amino acid sequence

SEQ ID NO: 514 - protein, 540 aa, Artificial Sequence; identical to SEQ ID NO: 478
  Synthetic amino acid sequence

SEQ ID NO: 515 - protein, 540 aa, Artificial Sequence; identical to SEQ ID NO: 478
  Synthetic amino acid sequence

SEQ ID NO: 516 - protein, 540 aa, Artificial Sequence; identical to SEQ ID NO: 498
  Synthetic amino acid sequence

SEQ ID NO: 517 - protein, 540 aa, Artificial Sequence; identical to SEQ ID NO: 478
  Synthetic amino acid sequence

SEQ ID NO: 518 - protein, 540 aa, Artificial Sequence; identical to SEQ ID NO: 473
  Synthetic amino acid sequence

SEQ ID NO: 519 - protein, 540 aa, Artificial Sequence; identical to SEQ ID NO: 473
  Synthetic amino acid sequence

SEQ ID NO: 520 - protein, 540 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVALAVAMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 521 - protein, 540 aa, Artificial Sequence; identical to SEQ ID NO: 245
  Synthetic amino acid sequence

SEQ ID NO: 522 - protein, 540 aa, Artificial Sequence; identical to SEQ ID NO: 520
  Synthetic amino acid sequence

SEQ ID NO: 523 - protein, 540 aa, Artificial Sequence; identical to SEQ ID NO: 245
  Synthetic amino acid sequence

SEQ ID NO: 524 - protein, 540 aa, Artificial Sequence; identical to SEQ ID NO: 245
  Synthetic amino acid sequence

SEQ ID NO: 525 - protein, 540 aa, Artificial Sequence; identical to SEQ ID NO: 245
  Synthetic amino acid sequence

SEQ ID NO: 526 - protein, 540 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVALAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 527 - protein, 540 aa, Artificial Sequence; identical to SEQ ID NO: 245
  Synthetic amino acid sequence

SEQ ID NO: 528 - protein, 540 aa, Artificial Sequence; identical to SEQ ID NO: 526
  Synthetic amino acid sequence

SEQ ID NO: 529 - protein, 540 aa, Artificial Sequence; identical to SEQ ID NO: 520
  Synthetic amino acid sequence

SEQ ID NO: 530 - protein, 540 aa, Artificial Sequence; identical to SEQ ID NO: 245
  Synthetic amino acid sequence

SEQ ID NO: 531 - protein, 540 aa, Artificial Sequence; identical to SEQ ID NO: 245
  Synthetic amino acid sequence

SEQ ID NO: 532 - protein, 540 aa, Artificial Sequence; identical to SEQ ID NO: 526
  Synthetic amino acid sequence

SEQ ID NO: 533 - protein, 540 aa, Artificial Sequence; identical to SEQ ID NO: 245
  Synthetic amino acid sequence

SEQ ID NO: 534 - protein, 540 aa, Artificial Sequence; identical to SEQ ID NO: 526
  Synthetic amino acid sequence

SEQ ID NO: 535 - protein, 540 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNTKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVALAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 536 - protein, 540 aa, Artificial Sequence; identical to SEQ ID NO: 535
  Synthetic amino acid sequence

SEQ ID NO: 537 - protein, 540 aa, Artificial Sequence; identical to SEQ ID NO: 535
  Synthetic amino acid sequence

SEQ ID NO: 538 - protein, 540 aa, Artificial Sequence; identical to SEQ ID NO: 245
  Synthetic amino acid sequence

SEQ ID NO: 539 - protein, 540 aa, Artificial Sequence; identical to SEQ ID NO: 245
  Synthetic amino acid sequence

SEQ ID NO: 540 - protein, 540 aa, Artificial Sequence; identical to SEQ ID NO: 245
  Synthetic amino acid sequence

SEQ ID NO: 541 - protein, 540 aa, Artificial Sequence; identical to SEQ ID NO: 245
  Synthetic amino acid sequence

SEQ ID NO: 542 - protein, 540 aa, Artificial Sequence; identical to SEQ ID NO: 520
  Synthetic amino acid sequence

SEQ ID NO: 543 - protein, 540 aa, Artificial Sequence; identical to SEQ ID NO: 245
  Synthetic amino acid sequence

SEQ ID NO: 544 - protein, 540 aa, Artificial Sequence; identical to SEQ ID NO: 245
  Synthetic amino acid sequence

SEQ ID NO: 545 - protein, 540 aa, Artificial Sequence; identical to SEQ ID NO: 245
  Synthetic amino acid sequence

SEQ ID NO: 546 - protein, 540 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQGLLNRGNLAAASDIVRLLALKNFGGVALAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 547 - protein, 540 aa, Artificial Sequence; identical to SEQ ID NO: 245
  Synthetic amino acid sequence

SEQ ID NO: 548 - protein, 540 aa, Artificial Sequence; identical to SEQ ID NO: 245
  Synthetic amino acid sequence

SEQ ID NO: 549 - protein, 540 aa, Artificial Sequence; identical to SEQ ID NO: 245
  Synthetic amino acid sequence

SEQ ID NO: 550 - protein, 540 aa, Artificial Sequence; identical to SEQ ID NO: 245
  Synthetic amino acid sequence

SEQ ID NO: 551 - protein, 540 aa, Artificial Sequence; identical to SEQ ID NO: 245
  Synthetic amino acid sequence

SEQ ID NO: 552 - protein, 540 aa, Artificial Sequence; identical to SEQ ID NO: 245
  Synthetic amino acid sequence

SEQ ID NO: 553 - protein, 540 aa, Artificial Sequence; identical to SEQ ID NO: 245
  Synthetic amino acid sequence

SEQ ID NO: 554 - protein, 540 aa, Artificial Sequence; identical to SEQ ID NO: 245
  Synthetic amino acid sequence

SEQ ID NO: 555 - protein, 540 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVALAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 556 - protein, 540 aa, Artificial Sequence; identical to SEQ ID NO: 245
  Synthetic amino acid sequence

SEQ ID NO: 557 - protein, 540 aa, Artificial Sequence; identical to SEQ ID NO: 526
  Synthetic amino acid sequence

SEQ ID NO: 558 - protein, 540 aa, Artificial Sequence; identical to SEQ ID NO: 245
  Synthetic amino acid sequence

SEQ ID NO: 559 - protein, 540 aa, Artificial Sequence; identical to SEQ ID NO: 526
  Synthetic amino acid sequence

SEQ ID NO: 560 - protein, 540 aa, Artificial Sequence; identical to SEQ ID NO: 245
  Synthetic amino acid sequence

SEQ ID NO: 561 - protein, 540 aa, Artificial Sequence; identical to SEQ ID NO: 526
  Synthetic amino acid sequence

SEQ ID NO: 562 - protein, 540 aa, Artificial Sequence; identical to SEQ ID NO: 526
  Synthetic amino acid sequence

SEQ ID NO: 563 - protein, 540 aa, Artificial Sequence; identical to SEQ ID NO: 526
  Synthetic amino acid sequence

SEQ ID NO: 564 - protein, 540 aa, Artificial Sequence; identical to SEQ ID NO: 546
  Synthetic amino acid sequence

SEQ ID NO: 565 - protein, 540 aa, Artificial Sequence; identical to SEQ ID NO: 526
  Synthetic amino acid sequence

SEQ ID NO: 566 - protein, 540 aa, Artificial Sequence; identical to SEQ ID NO: 245
  Synthetic amino acid sequence

SEQ ID NO: 567 - protein, 540 aa, Artificial Sequence; identical to SEQ ID NO: 245
  Synthetic amino acid sequence

SEQ ID NO: 568 - protein, 542 aa, Artificial Sequence
  Synthetic amino acid sequence
SLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVDMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKKNYFEGSL

SEQ ID NO: 569 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSL

SEQ ID NO: 570 - protein, 542 aa, Artificial Sequence; identical to SEQ ID NO: 568
  Synthetic amino acid sequence

SEQ ID NO: 571 - protein, 542 aa, Artificial Sequence; identical to SEQ ID NO: 569
  Synthetic amino acid sequence

SEQ ID NO: 572 - protein, 542 aa, Artificial Sequence; identical to SEQ ID NO: 569
  Synthetic amino acid sequence

SEQ ID NO: 573 - protein, 542 aa, Artificial Sequence; identical to SEQ ID NO: 569
  Synthetic amino acid sequence

SEQ ID NO: 574 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVDMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSL

SEQ ID NO: 575 - protein, 542 aa, Artificial Sequence; identical to SEQ ID NO: 569
  Synthetic amino acid sequence

SEQ ID NO: 576 - protein, 542 aa, Artificial Sequence; identical to SEQ ID NO: 574
  Synthetic amino acid sequence

SEQ ID NO: 577 - protein, 542 aa, Artificial Sequence; identical to SEQ ID NO: 568
  Synthetic amino acid sequence

SEQ ID NO: 578 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQEMASLWSFDDARAKAQFEEYKRNYFEGSL

SEQ ID NO: 579 - protein, 543 aa, Artificial Sequence
  Synthetic amino acid sequence
SLVNRKQLEKMANVRFRVQEDEYVAILDALEEYHNMSENTVVEKYLKLKDINSLTDTYIDTYKKSGRNKALKKFKEYLVIEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKHKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGAL

SEQ ID NO: 580 - protein, 542 aa, Artificial Sequence; identical to SEQ ID NO: 569
  Synthetic amino acid sequence

SEQ ID NO: 581 - protein, 542 aa, Artificial Sequence; identical to SEQ ID NO: 574
  Synthetic amino acid sequence

SEQ ID NO: 582 - protein, 542 aa, Artificial Sequence; identical to SEQ ID NO: 569
  Synthetic amino acid sequence

SEQ ID NO: 583 - protein, 542 aa, Artificial Sequence; identical to SEQ ID NO: 574
  Synthetic amino acid sequence

SEQ ID NO: 584 - protein, 543 aa, Artificial Sequence
  Synthetic amino acid sequence
SLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGAL

SEQ ID NO: 585 - protein, 543 aa, Artificial Sequence; identical to SEQ ID NO: 584
  Synthetic amino acid sequence

SEQ ID NO: 586 - protein, 543 aa, Artificial Sequence; identical to SEQ ID NO: 584
  Synthetic amino acid sequence

SEQ ID NO: 587 - protein, 542 aa, Artificial Sequence; identical to SEQ ID NO: 569
  Synthetic amino acid sequence

SEQ ID NO: 588 - protein, 542 aa, Artificial Sequence; identical to SEQ ID NO: 569
  Synthetic amino acid sequence

SEQ ID NO: 589 - protein, 542 aa, Artificial Sequence; identical to SEQ ID NO: 569
  Synthetic amino acid sequence

SEQ ID NO: 590 - protein, 542 aa, Artificial Sequence; identical to SEQ ID NO: 569
  Synthetic amino acid sequence

SEQ ID NO: 591 - protein, 542 aa, Artificial Sequence; identical to SEQ ID NO: 568
  Synthetic amino acid sequence

SEQ ID NO: 592 - protein, 542 aa, Artificial Sequence; identical to SEQ ID NO: 569
  Synthetic amino acid sequence

SEQ ID NO: 593 - protein, 542 aa, Artificial Sequence; identical to SEQ ID NO: 569
  Synthetic amino acid sequence

SEQ ID NO: 594 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPGLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSL

SEQ ID NO: 595 - protein, 542 aa, Artificial Sequence; identical to SEQ ID NO: 594
  Synthetic amino acid sequence

SEQ ID NO: 596 - protein, 542 aa, Artificial Sequence; identical to SEQ ID NO: 569
  Synthetic amino acid sequence

SEQ ID NO: 597 - protein, 542 aa, Artificial Sequence; identical to SEQ ID NO: 569
  Synthetic amino acid sequence

SEQ ID NO: 598 - protein, 543 aa, Artificial Sequence; identical to SEQ ID NO: 579
  Synthetic amino acid sequence

SEQ ID NO: 599 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDSRAKAQFEEYKRNYFEGSL

SEQ ID NO: 600 - protein, 542 aa, Artificial Sequence; identical to SEQ ID NO: 599
  Synthetic amino acid sequence

SEQ ID NO: 601 - protein, 542 aa, Artificial Sequence; identical to SEQ ID NO: 599
  Synthetic amino acid sequence

SEQ ID NO: 602 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQEMASLWSFDDSRAKAQFEEYKRNYFEGSL

SEQ ID NO: 603 - protein, 542 aa, Artificial Sequence; identical to SEQ ID NO: 602
  Synthetic amino acid sequence

SEQ ID NO: 604 - protein, 542 aa, Artificial Sequence; identical to SEQ ID NO: 569
  Synthetic amino acid sequence

SEQ ID NO: 605 - protein, 542 aa, Artificial Sequence; identical to SEQ ID NO: 594
  Synthetic amino acid sequence

SEQ ID NO: 606 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVDMLPGIQPGLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSL

SEQ ID NO: 607 - protein, 542 aa, Artificial Sequence; identical to SEQ ID NO: 606
  Synthetic amino acid sequence

SEQ ID NO: 608 - protein, 542 aa, Artificial Sequence; identical to SEQ ID NO: 574
  Synthetic amino acid sequence

SEQ ID NO: 609 - protein, 542 aa, Artificial Sequence; identical to SEQ ID NO: 606
  Synthetic amino acid sequence

SEQ ID NO: 610 - protein, 542 aa, Artificial Sequence; identical to SEQ ID NO: 574
  Synthetic amino acid sequence

SEQ ID NO: 611 - protein, 542 aa, Artificial Sequence; identical to SEQ ID NO: 574
  Synthetic amino acid sequence

SEQ ID NO: 612 - protein, 542 aa, Artificial Sequence; identical to SEQ ID NO: 574
  Synthetic amino acid sequence

SEQ ID NO: 613 - protein, 542 aa, Artificial Sequence; identical to SEQ ID NO: 606
  Synthetic amino acid sequence

SEQ ID NO: 614 - protein, 542 aa, Artificial Sequence; identical to SEQ ID NO: 574
  Synthetic amino acid sequence

SEQ ID NO: 615 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVIEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVDMLPGIQPGLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSL

SEQ ID NO: 616 - protein, 542 aa, Artificial Sequence
  Synthetic amino acid sequence
SLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASAILAISALKEVGGVALAVAMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKKNYFEGSL

SEQ ID NO: 617 - protein, 542 aa, Artificial Sequence; identical to SEQ ID NO: 247
  Synthetic amino acid sequence

SEQ ID NO: 618 - protein, 542 aa, Artificial Sequence; identical to SEQ ID NO: 616
  Synthetic amino acid sequence

SEQ ID NO: 619 - protein, 542 aa, Artificial Sequence; identical to SEQ ID NO: 247
  Synthetic amino acid sequence

SEQ ID NO: 620 - protein, 542 aa, Artificial Sequence; identical to SEQ ID NO: 247
  Synthetic amino acid sequence

SEQ ID NO: 621 - protein, 542 aa, Artificial Sequence; identical to SEQ ID NO: 247
  Synthetic amino acid sequence

SEQ ID NO: 622 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASAILAISALKEIGGMALAVAMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSL

SEQ ID NO: 623 - protein, 542 aa, Artificial Sequence; identical to SEQ ID NO: 247
  Synthetic amino acid sequence

SEQ ID NO: 624 - protein, 542 aa, Artificial Sequence; identical to SEQ ID NO: 622
  Synthetic amino acid sequence

SEQ ID NO: 625 - protein, 542 aa, Artificial Sequence; identical to SEQ ID NO: 616
  Synthetic amino acid sequence

SEQ ID NO: 626 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMALAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQEMASLWSFDDARAKAQFEEYKRNYFEGSL

SEQ ID NO: 627 - protein, 543 aa, Artificial Sequence
  Synthetic amino acid sequence
SLVNRKQLEKMANVRFRVQEDEYVAILDALEEYHNMSENTVVEKYLKLKDINSLTDTYIDTYKKSGRNKALKKFKEYLVIEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASAILAVAILKNIGGVALAVAMLPGIHPDLFKDINKPDSVKTAVDWEEMQLEAIMKHKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGAL

SEQ ID NO: 628 - protein, 542 aa, Artificial Sequence; identical to SEQ ID NO: 247
  Synthetic amino acid sequence

SEQ ID NO: 629 - protein, 542 aa, Artificial Sequence; identical to SEQ ID NO: 622
  Synthetic amino acid sequence

SEQ ID NO: 630 - protein, 542 aa, Artificial Sequence; identical to SEQ ID NO: 247
  Synthetic amino acid sequence

SEQ ID NO: 631 - protein, 542 aa, Artificial Sequence; identical to SEQ ID NO: 622
  Synthetic amino acid sequence

SEQ ID NO: 632 - protein, 543 aa, Artificial Sequence
  Synthetic amino acid sequence
SLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASAILAVAILKNIGGVALAVAMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGAL

SEQ ID NO: 633 - protein, 543 aa, Artificial Sequence; identical to SEQ ID NO: 632
  Synthetic amino acid sequence

SEQ ID NO: 634 - protein, 543 aa, Artificial Sequence; identical to SEQ ID NO: 632
  Synthetic amino acid sequence

SEQ ID NO: 635 - protein, 542 aa, Artificial Sequence; identical to SEQ ID NO: 247
  Synthetic amino acid sequence

SEQ ID NO: 636 - protein, 542 aa, Artificial Sequence; identical to SEQ ID NO: 247
  Synthetic amino acid sequence

SEQ ID NO: 637 - protein, 542 aa, Artificial Sequence; identical to SEQ ID NO: 247
  Synthetic amino acid sequence

SEQ ID NO: 638 - protein, 542 aa, Artificial Sequence; identical to SEQ ID NO: 247
  Synthetic amino acid sequence

SEQ ID NO: 639 - protein, 542 aa, Artificial Sequence; identical to SEQ ID NO: 616
  Synthetic amino acid sequence

SEQ ID NO: 640 - protein, 542 aa, Artificial Sequence; identical to SEQ ID NO: 247
  Synthetic amino acid sequence

SEQ ID NO: 641 - protein, 542 aa, Artificial Sequence; identical to SEQ ID NO: 247
  Synthetic amino acid sequence

SEQ ID NO: 642 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMALAVAMLPGIQPGLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSL

SEQ ID NO: 643 - protein, 542 aa, Artificial Sequence; identical to SEQ ID NO: 642
  Synthetic amino acid sequence

SEQ ID NO: 644 - protein, 542 aa, Artificial Sequence; identical to SEQ ID NO: 247
  Synthetic amino acid sequence

SEQ ID NO: 645 - protein, 542 aa, Artificial Sequence; identical to SEQ ID NO: 247
  Synthetic amino acid sequence

SEQ ID NO: 646 - protein, 543 aa, Artificial Sequence; identical to SEQ ID NO: 627
  Synthetic amino acid sequence

SEQ ID NO: 647 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMALAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDSRAKAQFEEYKRNYFEGSL

SEQ ID NO: 648 - protein, 542 aa, Artificial Sequence; identical to SEQ ID NO: 647
  Synthetic amino acid sequence

SEQ ID NO: 649 - protein, 542 aa, Artificial Sequence; identical to SEQ ID NO: 647
  Synthetic amino acid sequence

SEQ ID NO: 650 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMALAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQEMASLWSFDDSRAKAQFEEYKRNYFEGSL

SEQ ID NO: 651 - protein, 542 aa, Artificial Sequence; identical to SEQ ID NO: 650
  Synthetic amino acid sequence

SEQ ID NO: 652 - protein, 542 aa, Artificial Sequence; identical to SEQ ID NO: 247
  Synthetic amino acid sequence

SEQ ID NO: 653 - protein, 542 aa, Artificial Sequence; identical to SEQ ID NO: 642
  Synthetic amino acid sequence

SEQ ID NO: 654 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASAILAISALKEIGGMALAVAMLPGIQPGLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSL

SEQ ID NO: 655 - protein, 542 aa, Artificial Sequence; identical to SEQ ID NO: 654
  Synthetic amino acid sequence

SEQ ID NO: 656 - protein, 542 aa, Artificial Sequence; identical to SEQ ID NO: 622
  Synthetic amino acid sequence

SEQ ID NO: 657 - protein, 542 aa, Artificial Sequence; identical to SEQ ID NO: 654
  Synthetic amino acid sequence

SEQ ID NO: 658 - protein, 542 aa, Artificial Sequence; identical to SEQ ID NO: 622
  Synthetic amino acid sequence

SEQ ID NO: 659 - protein, 542 aa, Artificial Sequence; identical to SEQ ID NO: 622
  Synthetic amino acid sequence

SEQ ID NO: 660 - protein, 542 aa, Artificial Sequence; identical to SEQ ID NO: 622
  Synthetic amino acid sequence

SEQ ID NO: 661 - protein, 542 aa, Artificial Sequence; identical to SEQ ID NO: 654
  Synthetic amino acid sequence

SEQ ID NO: 662 - protein, 542 aa, Artificial Sequence; identical to SEQ ID NO: 622
  Synthetic amino acid sequence

SEQ ID NO: 663 - protein, 542 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVIEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASAILAISALKEIGGMALAVAMLPGIQPGLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSL

SEQ ID NO: 664 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLAVAMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENNGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 665 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 666 - protein, 2709 aa, Artificial Sequence; identical to SEQ ID NO: 664
  Synthetic amino acid sequence

SEQ ID NO: 667 - protein, 2709 aa, Artificial Sequence; identical to SEQ ID NO: 665
  Synthetic amino acid sequence

SEQ ID NO: 668 - protein, 2709 aa, Artificial Sequence; identical to SEQ ID NO: 665
  Synthetic amino acid sequence

SEQ ID NO: 669 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDVNTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 670 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEVATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAETATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 671 - protein, 2709 aa, Artificial Sequence; identical to SEQ ID NO: 669
  Synthetic amino acid sequence

SEQ ID NO: 672 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEVATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 673 - protein, 2709 aa, Artificial Sequence; identical to SEQ ID NO: 664
  Synthetic amino acid sequence

SEQ ID NO: 674 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTYNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 675 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 676 - protein, 2709 aa, Artificial Sequence; identical to SEQ ID NO: 672
  Synthetic amino acid sequence

SEQ ID NO: 677 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMKIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTYNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 678 - protein, 2709 aa, Artificial Sequence; identical to SEQ ID NO: 672
  Synthetic amino acid sequence

SEQ ID NO: 679 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNTKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTLSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTDANNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGNIYYFGNNSKAVTGWQTINGKVYYFMPDTAMAAAGGLFEIDGVIYFFGVDGVKAPGIYG

SEQ ID NO: 680 - protein, 2709 aa, Artificial Sequence; identical to SEQ ID NO: 679
  Synthetic amino acid sequence

SEQ ID NO: 681 - protein, 2709 aa, Artificial Sequence; identical to SEQ ID NO: 679
  Synthetic amino acid sequence

SEQ ID NO: 682 - protein, 2709 aa, Artificial Sequence; identical to SEQ ID NO: 665
  Synthetic amino acid sequence

SEQ ID NO: 683 - protein, 2709 aa, Artificial Sequence; identical to SEQ ID NO: 669
  Synthetic amino acid sequence

SEQ ID NO: 684 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 685 - protein, 2709 aa, Artificial Sequence; identical to SEQ ID NO: 665
  Synthetic amino acid sequence

SEQ ID NO: 686 - protein, 2709 aa, Artificial Sequence; identical to SEQ ID NO: 664
  Synthetic amino acid sequence

SEQ ID NO: 687 - protein, 2709 aa, Artificial Sequence; identical to SEQ ID NO: 665
  Synthetic amino acid sequence

SEQ ID NO: 688 - protein, 2709 aa, Artificial Sequence; identical to SEQ ID NO: 665
  Synthetic amino acid sequence

SEQ ID NO: 689 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTYNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 690 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQGLLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 691 - protein, 2709 aa, Artificial Sequence; identical to SEQ ID NO: 665
  Synthetic amino acid sequence

SEQ ID NO: 692 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 693 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGNKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKGIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 694 - protein, 2709 aa, Artificial Sequence; identical to SEQ ID NO: 693
  Synthetic amino acid sequence

SEQ ID NO: 695 - protein, 2709 aa, Artificial Sequence; identical to SEQ ID NO: 665
  Synthetic amino acid sequence

SEQ ID NO: 696 - protein, 2709 aa, Artificial Sequence; identical to SEQ ID NO: 674
  Synthetic amino acid sequence

SEQ ID NO: 697 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPNTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 698 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDVNTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 699 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGNKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKGIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 700 - protein, 2709 aa, Artificial Sequence; identical to SEQ ID NO: 675
  Synthetic amino acid sequence

SEQ ID NO: 701 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFASDSKAVTGLRTIDGKKYYFNTNTAVAATGWQTINGKKYYFNTNTSIASTGYTIINGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 702 - protein, 2709 aa, Artificial Sequence; identical to SEQ ID NO: 665
  Synthetic amino acid sequence

SEQ ID NO: 703 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFASDSKAVTGLRTIDGKKYYFNTNTAEAATGWQTINGKKYYFNTNTSIASTGYTIINGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 704 - protein, 2709 aa, Artificial Sequence; identical to SEQ ID NO: 675
  Synthetic amino acid sequence

SEQ ID NO: 705 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFASDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIEGQAIRYQNRFLHLLGNIYYFGNNSKAVTGWQTINGNMYYFMPDTAMAAAGGLFEIDGVIYFFGVDGVKAPGIYG

SEQ ID NO: 706 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFASDSKAVTGLRTIDGKKYYFNTNTAVAVTGWQTINGKKYYFNTNTSIASTGYTIINGKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 707 - protein, 2709 aa, Artificial Sequence; identical to SEQ ID NO: 672
  Synthetic amino acid sequence

SEQ ID NO: 708 - protein, 2709 aa, Artificial Sequence; identical to SEQ ID NO: 690
  Synthetic amino acid sequence

SEQ ID NO: 709 - protein, 2709 aa, Artificial Sequence; identical to SEQ ID NO: 706
  Synthetic amino acid sequence

SEQ ID NO: 710 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYENTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTSIASTGYTSINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 711 - protein, 2709 aa, Artificial Sequence
  Synthetic amino acid sequence
SLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 712 - protein, 2365 aa, Artificial Sequence
  Synthetic amino acid sequence
SLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLAVAMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGANMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEGRIEEAKSLTSDSINYIKNEFKLIESISDALYDLKQQNELEESHFISFEDILETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 713 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 714 - protein, 2365 aa, Artificial Sequence; identical to SEQ ID NO: 712
  Synthetic amino acid sequence

SEQ ID NO: 715 - protein, 2365 aa, Artificial Sequence; identical to SEQ ID NO: 713
  Synthetic amino acid sequence

SEQ ID NO: 716 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYRFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 717 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 718 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLAVAMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGANMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIEREISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 719 - protein, 2365 aa, Artificial Sequence; identical to SEQ ID NO: 717
  Synthetic amino acid sequence

SEQ ID NO: 720 - protein, 2365 aa, Artificial Sequence; identical to SEQ ID NO: 718
  Synthetic amino acid sequence

SEQ ID NO: 721 - protein, 2365 aa, Artificial Sequence; identical to SEQ ID NO: 712
  Synthetic amino acid sequence

SEQ ID NO: 722 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTDYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 723 - protein, 2366 aa, Artificial Sequence
  Synthetic amino acid sequence
SLVNRKQLEKMANVRFRVQEDEYVAILDALEEYHNMSENTVVEKYLKLKDINSLTDTYIDTYKKSGRNKALKKFKEYLVIEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLAVAMLPGIHPDLFKDINKPDSVKTAVDWEEMQLEAIMKHKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVTDKEYLLEKISSSTKSSERGYVHYIVQLQGDKISYEAACNLFAKNPYDSILFQKNIEDSEVAYYYNPTDSEIQEIDKYRIPDRISDRPKIKLTFIGHGKAEFNTDIFAGLDVDSLSSEIETAIGLAKEDISPKSIEINLLGANMFSYSVNVEETYPGKLLLRVKDKVSELMPSMSQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKVMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENNNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFDPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 724 - protein, 2365 aa, Artificial Sequence; identical to SEQ ID NO: 713
  Synthetic amino acid sequence

SEQ ID NO: 725 - protein, 2365 aa, Artificial Sequence; identical to SEQ ID NO: 718
  Synthetic amino acid sequence

SEQ ID NO: 726 - protein, 2365 aa, Artificial Sequence; identical to SEQ ID NO: 717
  Synthetic amino acid sequence

SEQ ID NO: 727 - protein, 2365 aa, Artificial Sequence; identical to SEQ ID NO: 718
  Synthetic amino acid sequence

SEQ ID NO: 728 - protein, 2366 aa, Artificial Sequence
  Synthetic amino acid sequence
SLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLAVAMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVIDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGANMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALYDLKQQNELEESHFISFEDISETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSSPSITYREPHLSIYDVLEVKKEELDLSKDLMVLPNAPNRVFGWETGWTPGLRGLENDGTKLLDRIRDQYEGQFYWRFFAFIADALITTLKPRYEDTNVRISLDSNTRSFIVPVITTEYIREKLSYSFYGSGGTYALSLSQYNMNINIELNENDTWVIDVDNVVRSVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLIIKVYMDNSKPPFGYYSNDLKDVKAITKDDVIILTGYYLKDDIKISLSFTIQDKNTIKLNGVYLDENGVAEILKFMNKKGSTNTSDSLMSFLESMNIKSIFIKSLKSNAKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYHLGLISLYNEKFYINNFGMMVSGLVYINDSLYYFKPPIKNLITGFTTIGDDKYYFNPDNGGAASVGETIIDGKNYYFSPNGVLQTGVFSTEDGFKYFAPADTLDENLEGEAIDFTGKLIIDENVYYFGDNYRAAIEWQTLDDEVYYFSTDTGRAFKGLNQIGDDKFYFNSDGIMQKGFVNINDKTFYFDDSGVMKSGYTEIDGKHFYFAENGEMQIGVFNTADGFKYFAHHDEDLGNEEGEALSYSGILNFNNKIYYFDDSFTAVVGWKDSEDGSKYYFDEDTAEAYIGISTINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYINIEDKMFYFNEDGVMQIGVFNTADGFKYFAHQNTLDENFEGESINYTGWLDLDEKRYYFTDEYIAAIGSVIIDGEEYYFDPDTAELVISE

SEQ ID NO: 729 - protein, 2366 aa, Artificial Sequence; identical to SEQ ID NO: 728
  Synthetic amino acid sequence

SEQ ID NO: 730 - protein, 2366 aa, Artificial Sequence
  Synthetic amino acid sequence
SLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLAVAMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVIDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGANMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALYDLKQQNELEESHFISFEDISETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSSPSITYREPHLSIYDVLEVKKEELDLSKDLMVLPNAPNRVFGWETGWTPGLRGLENDGTKLLDRIRDQYEGQFYWRFFAFIADALITTLKPRYEDTNVRISLDSNTRSFIVPVITTEYIREKLSYSFYGSGGTYALSLSQYNMNINIELNENDTWVIDVDNVVRSVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKDGLFVSELSDVVLIIKVYMDNSKPPFGYYSNDLKDVKAITKDDVIILTGYYLKDDIKISLSFTIQDKNTIKLNGVYLDENGVAEILKFMNKKGSTNTSDSLMSFLESMNIKSIFIKSLKSNAKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYHLGLISLYNEKFYINNFGMMVSGLVYINDSLYYFKPPIKNLITGFTTIGDDKYYFNPDNGGAASVGETIIDGKNYYFSPNGVLQTGVFSTEDGFKYFAPADTLDENLEGEAIDFTGKLIIDENVYYFGDNYRAAIEWQTLDDEVYYFSTDTGRAFKGLNQIGDDKFYFNSDGIMQKGFVNINDKTFYFDDSGVMKSGYTEIDGKHFYFAENGEMQIGVFNTADGFKYFAHHDEDLGNEEGEALSYSGILNFNNKIYYFDDSFTAVVGWKDSEDGSKYYFDEDTAEAYIGISTINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYINIEDKMFYFNEDGVMQIGVFNTADGFKYFAHQNTLDENFEGESINYTGWLDLDEKRYYFTDEYIAAIGSVIIDGEEYYFDPDTAELVISE

SEQ ID NO: 731 - protein, 2365 aa, Artificial Sequence; identical to SEQ ID NO: 713
  Synthetic amino acid sequence

SEQ ID NO: 732 - protein, 2365 aa, Artificial Sequence; identical to SEQ ID NO: 717
  Synthetic amino acid sequence

SEQ ID NO: 733 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMLSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 734 - protein, 2365 aa, Artificial Sequence; identical to SEQ ID NO: 713
  Synthetic amino acid sequence

SEQ ID NO: 735 - protein, 2365 aa, Artificial Sequence; identical to SEQ ID NO: 712
  Synthetic amino acid sequence

SEQ ID NO: 736 - protein, 2365 aa, Artificial Sequence; identical to SEQ ID NO: 713
  Synthetic amino acid sequence

SEQ ID NO: 737 - protein, 2365 aa, Artificial Sequence; identical to SEQ ID NO: 713
  Synthetic amino acid sequence

SEQ ID NO: 738 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPGLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 739 - protein, 2365 aa, Artificial Sequence; identical to SEQ ID NO: 738
  Synthetic amino acid sequence

SEQ ID NO: 740 - protein, 2365 aa, Artificial Sequence; identical to SEQ ID NO: 713
  Synthetic amino acid sequence

SEQ ID NO: 741 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 742 - protein, 2366 aa, Artificial Sequence; identical to SEQ ID NO: 723
  Synthetic amino acid sequence

SEQ ID NO: 743 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDSRAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 744 - protein, 2365 aa, Artificial Sequence; identical to SEQ ID NO: 743
  Synthetic amino acid sequence

SEQ ID NO: 745 - protein, 2365 aa, Artificial Sequence; identical to SEQ ID NO: 743
  Synthetic amino acid sequence

SEQ ID NO: 746 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQEMASLWSFDDSRAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 747 - protein, 2365 aa, Artificial Sequence; identical to SEQ ID NO: 746
  Synthetic amino acid sequence

SEQ ID NO: 748 - protein, 2365 aa, Artificial Sequence; identical to SEQ ID NO: 717
  Synthetic amino acid sequence

SEQ ID NO: 749 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETEEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKYFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 750 - protein, 2365 aa, Artificial Sequence; identical to SEQ ID NO: 738
  Synthetic amino acid sequence

SEQ ID NO: 751 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLAVAMLPGIQPGLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGANMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIRGEISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGVASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 752 - protein, 2365 aa, Artificial Sequence; identical to SEQ ID NO: 751
  Synthetic amino acid sequence

SEQ ID NO: 753 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLAVAMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGANMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIRREISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 754 - protein, 2365 aa, Artificial Sequence; identical to SEQ ID NO: 751
  Synthetic amino acid sequence

SEQ ID NO: 755 - protein, 2365 aa, Artificial Sequence; identical to SEQ ID NO: 753
  Synthetic amino acid sequence

SEQ ID NO: 756 - protein, 2365 aa, Artificial Sequence; identical to SEQ ID NO: 753
  Synthetic amino acid sequence

SEQ ID NO: 757 - protein, 2365 aa, Artificial Sequence; identical to SEQ ID NO: 718
  Synthetic amino acid sequence

SEQ ID NO: 758 - protein, 2365 aa, Artificial Sequence; identical to SEQ ID NO: 751
  Synthetic amino acid sequence

SEQ ID NO: 759 - protein, 2365 aa, Artificial Sequence; identical to SEQ ID NO: 753
  Synthetic amino acid sequence

SEQ ID NO: 760 - protein, 2365 aa, Artificial Sequence
  Synthetic amino acid sequence
SLVNRKQLEKMANVRFRTQEDEYVAILDALEEYHNMSENTVVEKYLKLKDINSLTDIYIDTYKKSGRNKALKKFKEYLVIEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLAVAMLPGIQPGLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGANMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIRGEISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGVASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 761 - protein, 2365 aa, Artificial Sequence; identical to SEQ ID NO: 86
  Synthetic amino acid sequence

SEQ ID NO: 762 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 763 - protein, 2710 aa, Clostridium difficile; identical to SEQ ID NO: 107

SEQ ID NO: 764 - protein, 2710 aa, Clostridium difficile; identical to SEQ ID NO: 136

SEQ ID NO: 765 - protein, 2710 aa, Clostridium difficile; identical to SEQ ID NO: 140

SEQ ID NO: 766 - protein, 2710 aa, Clostridium difficile; identical to SEQ ID NO: 151

SEQ ID NO: 767 - protein, 2710 aa, Clostridium difficile; identical to SEQ ID NO: 15

SEQ ID NO: 768 - protein, 2710 aa, Clostridium difficile; identical to SEQ ID NO: 100

SEQ ID NO: 769 - protein, 2710 aa, Clostridium difficile; identical to SEQ ID NO: 135

SEQ ID NO: 770 - protein, 2710 aa, Clostridium difficile; identical to SEQ ID NO: 88

SEQ ID NO: 771 - protein, 2710 aa, Clostridium difficile; identical to SEQ ID NO: 178

SEQ ID NO: 772 - protein, 2710 aa, Clostridium difficile; identical to SEQ ID NO: 92

SEQ ID NO: 773 - protein, 2710 aa, Clostridium difficile; identical to SEQ ID NO: 95

SEQ ID NO: 774 - protein, 2710 aa, Clostridium difficile; identical to SEQ ID NO: 97

SEQ ID NO: 775 - protein, 2710 aa, Clostridium difficile; identical to SEQ ID NO: 98

SEQ ID NO: 776 - protein, 2710 aa, Clostridium difficile; identical to SEQ ID NO: 102

SEQ ID NO: 777 - protein, 2710 aa, Clostridium difficile; identical to SEQ ID NO: 157

SEQ ID NO: 778 - protein, 2710 aa, Clostridium difficile; identical to SEQ ID NO: 150

SEQ ID NO: 779 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNLNTAEAATGWQTIDGKKYYFNTNTFIASTGYTIINGKHFYFNTDGIMQIGVFKGTNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGSDGFEYFAPANTDANNIEGQAIRYQNRFLYLHDNIYYFGNNSKAVTGWATIDGNRYYFEPDTAMGTNGYKTIDNKNFYFRNGLPQIGVFKGPNGFEYFAPANTDANNIDGQAIRYQNRFLHLLGNIYYFGNNSKAVTGWQTINGKVYYFMPDTAMAAAGGLFEIDGVIYFFGVDGVKAPGIYG

SEQ ID NO: 780 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKDSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNIKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLLYFDPIESNLVTGWQTINGKKYYFDINTGAASTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNLNTAEAATGWQTIDGKKYYFNTNTSIASTGYTIINGKYFYFNTDGIMQIGVFKGPNGFEYFAPANTHNNNIEGQAILYQNKFLTLNGKKYYFGSDSKAITGWQTIDGKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 781 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNVKLWYDSEAFLVNTLKKAIVESSTTEALQLLEEEIQNPQFDNTKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIYFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGNIYYFGNNSKAVTGWQTINGKVYYFMPDTAMAAAGGLFEIDGVIYFFGVDGVKAPGIYG

SEQ ID NO: 782 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKGIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAASTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 783 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYVQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENNGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 784 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTSINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 785 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNRLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 786 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 787 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENNGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLLYFDPIESNLVTGWQTINGKKYYFDINTGAASTSYKIINGKHFYFNNDGVMQLGVFKGPDGFEYFAPANTHNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGNIYYFGNNSKAVTGWQTINGKVYYFMPDTAMAAAGGLFEIDGAIYFFGVDGVKAPGIYG

SEQ ID NO: 788 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNVKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNIKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLLYFDPIESNLVTGWQTINGKKYYFDINTGAASTSYKIINGKHFYFNNDGVMQLGVFKGPDGFEYFAPANTHNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGNIYYFGNNSKAVTGWQTINGKVYYFMPDTAMAAAGGLFEIDGAIYFFGVDGVKAPGIYG

SEQ ID NO: 789 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNTKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGNIYYFGNNSKAVTGWQTINGKVYYFMPDTAMAAAGGLFEIDGVIYFFGVDGVKAPGIYG

SEQ ID NO: 790 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTYNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 791 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALYKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGSVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEVATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 792 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANGLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 793 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGNKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKGIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDDNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 794 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTIINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 795 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPKNNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 796 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNLNTAEAATGWQTIDGKKYYFNTNTFIASTGYTIINGKHFYFNTDGIMQIGVFKGTNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGSDGFEYFAPANTDANNIEGQAIRYQNRFLYLHDNIYYFGNNSKAVTGWATIDGNRYYFEPDTAMGANGYKTIDNKNFYFRNGLPQIGVFKGPNGFEYFAPANTDANNIDGQAIRYQNRFLHLLGNIYYFGNNSKAVTGWQTINGKVYYFMPDTAMAAAGGLFEIDGVIYFFGVDGVKAPGIYG

SEQ ID NO: 797 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANGLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNIEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIALDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNLNTAEAATGWQTIDGKKYYFNTNTFIASTGYTIINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGSDGFEYFAPANTDANNIEGQAIRYQNRFLYLHDNIYYFGNNSKAVTGWATIDGNRYYFEPDTAMGANGYKTIDNKNFYFRNGLPQIGVFKGPNGFEYFAPANTDANNIDGQAIRYQNRFLHLLGNIYYFGNNSKAVTGWQTINGKVYYFMPDTAMAAAGGLFEIDGVIYFFGVDGVKAPGIYG

SEQ ID NO: 798 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTLSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANIHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINGKVYYFMPDTAMAAAGGLFEIDGVIYFFGVDGVKAPGIYG

SEQ ID NO: 799 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTAFDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENNGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 800 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEVATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

SEQ ID NO: 801 - protein, 2366 aa, Clostridium difficile; identical to SEQ ID NO: 2

SEQ ID NO: 802 - protein, 2366 aa, Clostridium difficile; identical to SEQ ID NO: 21

SEQ ID NO: 803 - protein, 2367 aa, Clostridium difficile; identical to SEQ ID NO: 121

SEQ ID NO: 804 - protein, 2366 aa, Clostridium difficile; identical to SEQ ID NO: 116

SEQ ID NO: 805 - protein, 2366 aa, Clostridium difficile; identical to SEQ ID NO: 120

SEQ ID NO: 806 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESATNDTLESFRENLNDPRFDYNKFFRKRMEIIYDKQKNFINYYKAQREENPELIIDDIVKTYLSNEYSKEIDELNAYIEESLNKITQNSGNDVRNFEEFKNGESFNLYEQELVERWNLAAASDILRISALKEIGGVYLDVDMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEDSMNIHLIEADLRNFEIPKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSILFQKNIEDSEIAYYYNPGDGEIQEIDKYKIPSIISDRPKIKLTFIGHGKDEFNTDIFAGLDVDSLSTEIETAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKNEFKLIESISDALCDLKQQNELDDSHFISFEDISETDEGFSIRFINKETGESIFVETEKTIFSEYANHITEEISKIKDTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTITDDIDHFFSAPSITYREPHLSIYDVLEVQKEELDLSKDLMVLPNAPNRVFAWETGWTPGLRSLENDGTKLLDRIRDHYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGDVNGSNGFVSLTFSILEGINAIIEVDLLSKSYKLLISGELKILMLNSNHIQQKIDYIGFNSELQKNIPYSFVNDEGKENGFINGSTKEGLFVSELPDVVLISKVYMDDSKPSFGYYSNNLKDVKVITKDDVNILTGYYLKDDIKISLSLTLQDEKTIKLNSVHLDESGVAEILKFMNKKGSTNTSDSLMSFLESMNIKSIFVNFLQSNIKFILDTNFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSKIISSFTPSYYDGGLIGYGLGLVSLYNEKFYINNFGMMVSGLIYINDSLYYFKPPVNNLITGFMTVGDDKYYFNPTNGGAASIGETIIDDKNYYFNQSGVLQTGVFSTEDGFKYFAPANTLDENLEGEAIDFTGKLIIDENIYYFEDNYRGAVEWKELDGEMYYFSPETGKAFKGLNQIGDDKYYFNSDGVMQKGFVSINDKKHYFDDSGVMKVGYTEIDGKYFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVAINDKVFYFSDSGIIESGVQNIDDNYFYIDEKGIVQIGVFDTSDGYKYFAPANTVNDNIYGQAVEYSGLVRVGEDVYYFGETYTIETGWIYDMENESDKYYFNPETKKACKGINLIDDIKYYFDENGIMRTGLISFENNDYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 807 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDSRAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 808 - protein, 2366 aa, Clostridium difficile; identical to SEQ ID NO: 115

SEQ ID NO: 809 - protein, 2366 aa, Clostridium difficile; identical to SEQ ID NO: 131

SEQ ID NO: 810 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPGLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 811 - protein, 2367 aa, Clostridium difficile; identical to SEQ ID NO: 126

SEQ ID NO: 812 - protein, 2366 aa, Clostridium difficile; identical to SEQ ID NO: 111

SEQ ID NO: 813 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 814 - protein, 2366 aa, Clostridium difficile; identical to SEQ ID NO: 114

SEQ ID NO: 815 - protein, 2366 aa, Clostridium difficile; identical to SEQ ID NO: 179

SEQ ID NO: 816 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVIEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 817 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETEEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 818 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKVQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVTDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGCNMFSYSVNVEETYPGKLLLRVKDKISELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEERIEEAKSLTSDSINYIKNEFKLIESISDALYDLKQQNELEESHFISFEDISETDEGFSIRFIDKETGESIFVETEKAIFSEYANHITEEISKLKDTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTNDIDHFFSSPSITYREPHLSIYDVLEVKKEELDLSKDLMVLPNAPNRVFGWETGWTPGLRSLENDGTKLLDRIRDQYEGQFYWRFLAFIADALITTLKPRYEDTNVRINLDSNTRSFIVPIITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGLSLINDGQYYFNDDGIMQVGFVAINDKVFYFSDSGIIESGVQNIDDNYFYIDEKGIVQIGVFDTSDGYKYFAPANTVNDNIYGQAVEYSGLVRVGEDVYYFGETYTIETGWIYDMENESDKYYFDPETKKACKGINTIHDIKYYFDETGIMRTGLITFENNHYYFNEDGEMQYGYLNIEDKMFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 819 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVIDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALYDLKQQNELEESHFISFEDISETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSSPSITYREPHLSIYDVLEVKKEELDLSKDLMVLPNAPNRVFGWETGWTPGLRGLENDGTKLLDRIRDQYEGQFYWRFFAFIADALITTLKPRYEDTNVRISLDSNTRSFIVPVITTEYIREKLSYSFYGSGGTYALSLSQYNMNINIELNENDTWVIDVDNVVRSVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLIIKVYMDNSKPPFGYYSNDLKDVKAITKDDVIILTGYYLKDDIKISLSFTIQDKNTIKLNGVYLDENGVAEILKFMNKKGSTNTSDSLMSFLESMNIKSIFIKSLKSNAKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYHLGLISLYNEKFYINNFGMMVSGLVYINDSLYYFKPPIKNLITGFTTIGDDKYYFNPDNGGAASVGETIIDGKNYYFSPNGVLQTGVFSTEDGFKYFAPADTLDENLEGEAIDFTGKLIIDENVYYFGDNYRAAIEWQTLDDEVYYFSTDTGRAFKGLNQIGDDKFYFNSDGIMQKGFVNINDKTFYFDDSGVMKSGYTEIDGKHFYFAENGEMQIGVFNTADGFKYFAHHDEDLGNEEGEALSYSGILNFNNKIYYFDDSFTAVVGWKDSEDGSKYYFDEDTAEAYIGISTINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKMFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 820 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 821 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGISLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 822 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETEEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKVMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKLSFGYYSNNLKDVKVITKDNVNILTGCYLKDDIKISLSLTLQDEKTIKLNSVHLDESGVAEILKFMNRKGSTNTSDSLMSFLESMNIKSIFVNLLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVVVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 823 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETEEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGDVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPISEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKYFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDEKGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 824 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVDMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGCNMFSYSVNVEETYPGKLLLRVKDKISELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEERIEEAKSLTSDSINYIKNEFKLIESISDALYDLKQQNELEESHFISFEDISETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSSPSITYREPHLSIYDVLEVKKEELDLSKDLMVLPNAPNRVFGWETGWTPGLRGLENDGTKLLDRIRDQYEGQFYWRFFAFIADALITTLKPRYEDTNVRISLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLIIKVYMDNSKPPFGYYSNDLKDVKAITKDDVIILTGYYLKDDIKISLSFTIQDENTIKLNGVYLDENGVAEILKFMNKKGSTNTSDSLMSFLESMNIKSIFINSLQSNTKLILDTNFIISGATSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYHLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYINIEDKMFYFNEDGVMQIGVFNTADGFKYFAHQNTLDENFEGESINYTGWLDLDEKRYYFTDEYIAAIGSVIIDGEEYYFDPDTAELVISE

SEQ ID NO: 825 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEGISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 826 - protein, 2366 aa, Clostridium difficile
MSLVNRKQLEKMANVKFRTQEDEYVAILDALEEYHNMSENTVVEKYLKLKDINSLTDAYIDTYKKSGRNKALKKFKEYLTTEVIELKNSNLTPVEKNLHFVWIGGQISDTAINYINQWKDVNSDYNTNVFYDSNAFLINTLKKTIVEATTNDTLESFSENLNDPRFDHNNFYRKRMEMIYDKQKNFINYYKAQREENPELIIDDIVKTYLSNEYSKEIDELNAYIEESLNKITQNSGNDVRNFEEFKNGESFKLYEQELVERWNLAAASDILRISALKEIGGVYLDVDMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEDSMNIHLIEADLRNFEISKTNISQSTEQEMASLWSFDDARAKAQFEEYKRNYFEGALGEDDNLDFSQNTVVDKEYLLEKISSLARSSERGYIHYIVQLQGDKISYEAACNLFAKTPYDSILFQKNIEDSEIAYYYNPGDDEIQEIDKYRIPSIISDRPKIKLTFIGHGKDEFNTDIFAGLDVDSLSTEIETVIDLAKEDISPKAIEINLLGCNMFSYSINIEETYPGKLLLKVKDKISELMPSISQDSIIVSANQYEVRINSEGRRELLDHSGEWINKEESIIKDISSKEYISFNSKENKIIVKSKNLPELSTLLQEIRNNSNSSDIELEEKVMLAECEINVISNIDTQIVEERIEEAKNLTSDSINYIKNEFKLIESISDALCDLKQQNELEDSHFISFEDISETDEGFSIRFINKETGESIFVETEKTIFSEYANHITEEISKVKDTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPVIATIIDGVSLGSAIKELSETSDPLLRQEIEAKIGIMAVNLTAATTAIITSALGIASGFSILLVPLAGISAGIPSLVNNELILRDKATKVVDYFKHISLAETEGAFTLLDDKIIMPQDDLVISEIDFNNNSITLGKCEIWRMEGGSGHTVTDDIDHFFSSPSITYREPYLSIYDVLEVQKEELDLSKDLMVLPNAPNRVFAWETGWTPGLRSLENDGTKLLDRIRNHYEGEFYWRYFAFIADALITTLKPRYEDTNIRINLDSNTRSFVVPVITTEYIRENLSYSFYGSGGTYALSLSQYNMGINIELSESDVWIIDVDNVVRDVTIESDKIKKGDLIEGILSTLSIEDNKIILNSHELNFSGDVNGSNGFVSLTFSILEGINAIIEVDLLSKSYKLLLSGELKTLMSNSNYIQQKIDYIGFNSELQKNIPYSFVDAEGKKNGFINVSTKEGLFASELSDVVLISKVYMDNSKPSFGHYSDILKDVKVITKDDINILTGYYLKDDIKISLSFTLQDEHTIKLNGVHLDEKGVAEILTFMNKKVGTNTSDSLMSFLKSMNINNVFSHSLQDKVNLVLETNFIISGMTSIGQFEFICDENDNIQPYFIKFNALDTKYTLYLGNRQNMIVEPNYDLDDSGNISSTVINFSQKHLYGIDSFINKVIISPNLYTDEINITPVHETNNTYPEVIVLDANYISEKIKVNINDLSIRYIWSNDGNDFILMSTIGEDKASQVKIRFANVFKGNTLANKLSFNFSDKQDVSLSEIISAFTPSKYEDGFSSYKLGLISFYNEKFYINNFGMKVSGLIYINDSLYYFKPPVNNLITGFTTVGDDKYYFNPTNGGAASIGDTIIDDKNYYFNQIGVLQTGVFSTEDGFKYFAPANTLDENLEGEAIDFTGKLIIDENIYYFEDNYRGAVEWKELDGEMYYFSPETGKAFKGLNQIGDDKYYFNSDGIMQKGFVSINDKKHYFDDSGVMKVGYTEIDGKYFYFAENGEMQIGVFNTSDGFKYFAHYNEDLGNEEGEALSYSGILNFNNKIYYFDDSFTAVVGWRNLDDGSKYYFDENTAEAFIGFSLINDEQYYFNEDGIMQVGFVTINDRVFYFSDSGIIESGVQNIDDNYFYIDEKGIVQIGVFDTSDGYKYFAPPNTVNENIYGQAVEYSGLVKVNEDVYYFGETYLIETGWIYDMENESDKYYFDPETKKAYKGINVINDTKYYFDENGIMRTGLISFENNHYYFNEDGVMQSGYINIEDKMFYFSEDGIMQIGVFNTPDGFKYFAHQNTLDDNFEGESINYTGWLDFNEKRYYFTDEYIAATGSVTIDDEEYYFDPDTAELVLSE

SEQ ID NO: 827 - protein, 2367 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESATNDTLESFRENLNDPEFNHTAFFRKRMQIIYDKQQNFINYYKAQKEENPDLIIDDTVKSYLSDEYSKDIDELNAYIEESLNKIAENSGNDVRNFEEFKDGEVFNLYEQELVERWNLAAASDILRVAILKNIGGVYLDVDMLPGIHPDLFKNINKPDSVKTAVDWEEMQLEAIMKYKEYIPEYTSKHFDTLDEEVQSSFESVLASKSDKSEIFLPLGDIEVSPLEVKIAFAKGSIINQALISVKDSYCSDLLIKQIQNRYKILNDTLGPIISQGNDFNTTMNSFGESLGAISSEDNISFIAKIGSYLRVGFYPEANTTITLSGPTVYAGAYKDLLTFKEISLDTSILTSELRNFEFPKDNISQATEQEKNSLWQFNEERAKIQFEEYKRAYFEGALGEDDNLDFSQNIVTDKEYLLEKISSSTKSSERGYVHYIVQLQGDKISYEAACNLFAKNPYDSILFQKNIEDSEIAYYYNPADGEIQEIDKYRIPDRISDRPKIKLTFIGHGKDEFNTDIFAGLDVDSLSTEIETAIDLAKEDISSKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSILLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIEREISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIIDDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDGYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMHFGYINIEDKMFYFGEDGVMQIGVFNTPDGFKYFAHQNTLDENFEGESINYTGWLDLEGKRYYFTDEYIAATGTVTIDGEEYYFDPDTAELVVSE

SEQ ID NO: 828 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKVQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVTDKEYLLEKISSSTKSSERGYVHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIGLAKEDISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEERIEEAKSLTSDSINYIKNEFKLIESISDALYDLKQQNELEESHFISFEDISETDEGFSIRFIDKETGESIFVETEKAIFSEYANHITEEISKLKDTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTNDIDHFFSSPSITYREPHLSIYDVLEVKKEELDLSKDLMVLPNAPNRVFGWETGWTPGLRSLENDGTKLLDRIRDQYEGQFYWRFLAFIADALITTLKPRYEDTNVRISLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGATSIGQFEFICDKDNNIQPYFIKFNTLETKYTLYVGNRQNMIVEPNYDLDDSGDISSTVINFSQKYLYGIDSCVNKVIISPNIYTDEINITPVYEANNTYPEVIVLDTNYISEKINININDLSIRYVWSNDESDFILMSTDEENKVSQVKIRFTNVFKGNTISDKISFNFSDKQDVSINKIISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGLSLINDGQYYFNDDGIMQVGFVAINDKVFYFSDSGIIESGVQNIDDNYFYIDEKGIVQIGVFDTSDGYKYFAPANTVNDNIYGQAVEYSGLVRVGEDVYYFGETYTIETGWIYDMENESDKYYFDPETKKACKGINTIHDIKYYFDETGIMRTGLITFENNHYYFNEDGEMQYGYLNIEDKMFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 829 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKYKEYIPEYTSKHFDTLDEEVQSSFESVLASKSDKSEIFLPLGDIEVSPLEVKVAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVTDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALYDLKQQNELEESHFISFEDISKTDEGFSIRFIDKETGESIFVETEKAIFSEYANHITEEISKLKDTIFDTVNGKLVKKVTLDATHEVNTLNAAFFIQSLIGYNSSKESLSNLSVAMKVQVYAQLFSTGLNTITDAAKVVELVSTALDETIDLLPTLSEGLPVIATIIDGVSLGASIKELSETSDPLLRQEIEAKIGIMAVNLTAATTAIITSSLGIASGFSILLVPLAGISAGIPSLVNNELILRAEAKNVVDYFGHISLAESEGAFTLLDDKIMMPQDDLVISEIDFNNNSITLGKCEIWRMEGGSGHTVTDDIDHFFSAPSTTYREPYLSIYDVLDVKKEELDLSKDLMVLPNAPDRIFGWERGWTPGLRSLENDGTKLLDRIRDHYEGQFYWRFFAFIADSVITKLKPRYEDTNIRISLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDEGKENGFINCFTKEGLFVSELSDVVLIIKVYMDNSKPPFGYYSNDLKDVKVITKDDVIILTGYYLKDDIKISLSFTIQDKNTIKLNGVYLDENGVAEILKFMNKKGSTNTSDSLMSFLESMNIKSIFIKSLKSNAKLILDTNFIISGTTSIGQFEFICDKDNNIQPYFIKFNTLETKYTLYVGNRQNMIVEPNYNLDDSGDISSTVINFSQKYLYGIDSCVNKVIISPNIYTDEINITPVHEANNTYPEVIVLDTNYISEKINININDLSIRYVWSNDGSDFILMSTDEENKVSQVKIRFTNVFKGNTISDKISFNFSDKQDISINKIISTFTPSYYVEGLLNYDLGLISLYNEKFYINNLGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLIIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDENTAEASIGISIINDGKYYFNDSGIMQIGFVTINNEVFYFSDSGIVESGMQNIDDNYFYISENGLVQIGVFDTSDGYKYFAPANTVNDNIYGQAVEYSGLVRVNEDVYSFGESYTIETGWIYDSENESDKYYFDPETKKAYKGINVIDDIKYYFDENGIMRTGLITFEDNHYYFNEDGEMQYGYLNIEDKMFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 830 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKVQKEENPDLIIDDIVKTYLSNEYSKDIDELNAYIEESLNKVTENSGNDVRDFEEFKTGEVFNLYEQELVERWNLAGASDILRVAILKNIGGVYLDVDMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVTDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGCNMFSYSVNVEETYPGKLLLRVKDKISELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEERIEEAKSLTSDSINYIKNEFKLIESISDALYDLKQQNELEESHFISFEDISETDEGFSIRFIDKETGESIFVETEKAIFSEYANHITEEISKLKDTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTNDIDHFFSSPSITYREPHLSIYDVLEVKKEELDLSKDLMVLPNAPNRVFGWETGWTPGLRSLENDGTKLLDRIRDQYEGQFYWRFLAFIADALITTLKPRYEDTNVRINLDSNTRSFIVPIITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEALLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGLSLINDGQYYFNDDGIMQVGFVAINDKVFYFSDSGIIESGVQNIDDNYFYIDEKGIVQIGVFDTSDGYKYFAPANTVNDNIYGQAVEYSGLVRVGEDVYYFGETYTIETGWIYDMENESDKYYFDPETKKACKGINTIHDIKYYFDETGIMRTGLITFENNHYYFNEDGEMQYGYLNIEDKMFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 831 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKVQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKYKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVTDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGCNMFSYSVNVEETYPGKLLLRVKDKISELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEERIEEAKSLTSDSINYIKNEFKLIESISDALYDLKQQNELEESHFISFEDISETDEGFSIRFIDKETGESIFVETEKAIFSEYANHITEEISKLKDTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTNDIDHFFSSPSITYREPHLSIYDVLEVKKEELDLSKDLMVLPNAPNRVFGWETGWTPGLRSLENDGTKLLDRIRDQYEGQFYWRFLAFIADALITTLKPRYEDTNVRINLDSNTRSFIVPIITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 832 - protein, 2367 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESATNDTLESFRENLNDPEFNHTAFFRKRMQIIYDKQQNFINYYKAQKEENPDLIIDDTVKSYLSDEYSKDIDELNAYIEESLNKIAENSGNDVRNFEEFKDGEVFNLYEQELVERWNLAAASDILRVAILKNIGGVYLDVDMLPGIHPDLFKNINKPDSVKTAVDWEEMKLEAIMKYKEYIPEYTSKHFDTLDEEVQSSFESVLASKSDKSEIFLPLGDIEVSPLEVKIAFAKGSIINQALISVKDSYCSDLLIKQIQNRYKILNDTLGPIISQGNDFNTTMNSFGESLGAISSEDNISFIAKIGSYLRVGFYPEANTTITLSGPTVYAGAYKDLLTFKEISLDTSILTSELRNFEFPKDNISQATEQEKNSLWQFNEERAKIQFEEYKRAYFEGALGEDDNLDFSQNTVTDKEYLLEKISSSTKSSERGYVHYIVQLQGDKISYEAACNLFAKNPYDSILFQKNIEDSEIAYYYNPADGEIQEIDKYRIPDRISDRPKIKLTFIGHGKDEFNTDIFAGLDVDSLSTEIETAIDLAKEDISSKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIEREISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIIDDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMKKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDGYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMHFGYINIEDKMFYFGEDGVMQIGVFNTPDGFKYFAHQNTLDENFEGESINYTGWLDLEGKRYYFTDEYIAATGTVTIDGEEYYFDPDTAELVVSE

SEQ ID NO: 833 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISISLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNIFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 834 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEIFKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFGEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 835 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKYKEYIPEYTSKHFDTLDEEVQSNFESVLASKSDKSEIFLPLGDIEVSPLEVKVAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVTDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETIIDLAKADISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALYDLKQQNELEESHFISFEDISKTDEGFSIRFIDKETGESIFVETEKAIFSEYANHITEEISKLKDTIFDTVNGKLVKKVNLDATHEVNTLNAAFFIQSLIGYNSSKESLSNLSVAMKVQVYAQLFSTGLNTITDAAKVVELVSTALDETIDLLPTLSEGLPVIATIIDGVSLGASIKELSETSDPLLRQEIEAKIGIMAVNLTAATTAIITSSLGIASGFSILLVPLAGISAGIPSLVNNELILRAEAKNVVDYFGHISLAESEGAFTLLDDKIMMPQDDLVISEIDFNNNSITLGKCEIWRMEGGSGHTVTDDIDHFFSAPSTTYREPYLSIYDVLDVKKEELDLSKDLMVLPNAPDRIFGWERGWTPGLRSLENDGTKLLDRIRDHYEGQFYWRFFAFIADSVITKLKPRYEDTNIRISLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDEGKENGFINCFTKEGLFVSELSDVVLIIKVYMDNSKPPFGYYSNDLKDVKVITKDDVIILTGYYLKDDIKISLSFTIQDKNTIKLNGVYLDENGVAEILKFMNKKGSTNTSDSLMSFLESMNIKSIFIKSLKSNAKLILDTNFIISGTTSIGQFEFICDKDNNIQPYFIKFNTLETKYTLYVGNRQNMIVEPNYNLDDSGDISSTVINFSQKYLYGIDSCVNKVIISPNIYTDEINITPVHEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYHLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEELGNEEGEALSYSGILNFNNKIYYFDDSFTAVVGWKDLEDGSKYYFDEDTAEAYIGISIINDSKYYFNDSGIMQIGFVTINNEVFYFSDSGIVESGMQNIDDNYFYIDENGLVQIGVFDTSDGYKYFAPANTVNDNIYGQAVEYSGLVRVNEDVYSFGESYTIETGWIYDSENESDKYYFDPETKKAYKGINVIDDIKYYFDENGIMRTGLITFENNHYYFNEDGEMQYGYLNIEDKMFYFSEDGIMQIGVFNTPDGFKYFAHQNTLDENFEGESINYTGWLDLDEKRYYFTDEYIAATGSVIIDGEEYYFDPDTAELVISE

SEQ ID NO: 836 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKVSELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 837 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYNKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKVMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGNNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGCYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 838 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENDNIQPYFIKFNTRETNYTLYVGNRQNMIVEPNYDLDDSGDISSTVINFSQKYLYGIDSCVNKVVISPNIYTDEINITPVYETNNTYPEVIVLDTNYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 839 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMLSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYLYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 840 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVDMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGCNMFSYSVNVEETYPGKLLLRVKDKISELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEERIEEAKSLTSDSINYIKNEFKLIESISDALYDLKQQNELEESHFISFEDISETDEGFSIRFIDKETGESIFVETEKAIFSEYANHITEEISKLKDTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTNDIDHFFSSPSITYREPHLSIYDVLEVKKEELDLSKDLMVLPNAPNRVFGWETGWTPGLRSLENDGTKLLDRIRDQYEGQFYWRFLAFIADALITTLKPRYEDTNVRISLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGATSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKIISTFTPSYYVEGLLNYHLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 841 - protein, 664 aa, Clostridium difficile
QVQLQQPGAALVKSGASVKLSCKASGYTFTSYWIHWVKQRPGQGLEWIGVINPSNGRSSYNEKFKSKATLTVDKSSSTAYMQFNSLTSEDSAVYYCARAYYGTSYYAMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGKDVLMTQTPLSLPVSLGDQASISCRSSQSIVHSNGNTYLEWYLQTPGQSPKLLIYKVSNRFSGVPDRFSGSGSGTDFTLKISRVEAEDLGVYYCFQGSHFPFTFGTGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 842 - protein, 21 aa, Artificial Sequence
  Synthetic amino acid sequence
KNIAYNYTDESNNKYFGAISK

SEQ ID NO: 843 - protein, 13 aa, Artificial Sequence
  Synthetic amino acid sequence
SKKYGPLKTEDDK

SEQ ID NO: 844 - protein, 4 aa, Artificial Sequence
  Synthetic amino acid sequence
IYSA

SEQ ID NO: 845 - protein, 13 aa, Artificial Sequence
  Synthetic amino acid sequence
LRSLENDGTRLLD

SEQ ID NO: 846 - protein, 8 aa, Artificial Sequence
  Synthetic amino acid sequence
FNHLSESK

SEQ ID NO: 847 - protein, 10 aa, Artificial Sequence
  Synthetic amino acid sequence
SAIGIETENL

SEQ ID NO: 848 - protein, 9 aa, Artificial Sequence
  Synthetic amino acid sequence
ENDGTRLLD

SEQ ID NO: 849 - protein, 13 aa, Artificial Sequence
  Synthetic amino acid sequence
SKKYGPLKTEDDK

SEQ ID NO: 850 - protein, 13 aa, Artificial Sequence
  Synthetic amino acid sequence
LRSLENDGTRLLD

SEQ ID NO: 851 - protein, 15 aa, Artificial Sequence
  Synthetic amino acid sequence
HLSESKKYGPLKTED

SEQ ID NO: 852 - protein, 9 aa, Artificial Sequence
  Synthetic amino acid sequence
SLENDGTRL

SEQ ID NO: 853 - protein, 11 aa, Artificial Sequence
  Synthetic amino acid sequence
SKKYGPLKTED

SEQ ID NO: 854 - protein, 8 aa, Artificial Sequence
  Synthetic amino acid sequence
LENDGTRL

SEQ ID NO: 855 - protein, 11 aa, Artificial Sequence
  Synthetic amino acid sequence
AGIPSLVNNEL

SEQ ID NO: 856 - protein, 13 aa, Artificial Sequence
  Synthetic amino acid sequence
MPTITTNEIRNKL

SEQ ID NO: 857 - protein, 10 aa, Artificial Sequence
  Synthetic amino acid sequence
LSSYPISTNI

SEQ ID NO: 858 - protein, 7 aa, Artificial Sequence
  Synthetic amino acid sequence
SIENGTI

SEQ ID NO: 859 - protein, 10 aa, Artificial Sequence
  Synthetic amino acid sequence
NKLIIGNQTI

SEQ ID NO: 860 - protein, 35 aa, Artificial Sequence
  Synthetic amino acid sequence
ISIENGTIKKGKLIKDVLSKIDINKNKLIIGNQTI

SEQ ID NO: 861 - protein, 24 aa, Artificial Sequence
  Synthetic amino acid sequence
NTNTAEAATGWQTIDGKKYYFNTN

SEQ ID NO: 862 - protein, 18 aa, Artificial Sequence
  Synthetic amino acid sequence
AATGWQTIDGKKYYFNTN

SEQ ID NO: 863 - protein, 18 aa, Artificial Sequence
  Synthetic amino acid sequence
AATGWQTIDGKKYYFNLN

SEQ ID NO: 864 - protein, 18 aa, Artificial Sequence
  Synthetic amino acid sequence
AATGWQTIDGKKYYFNTN

SEQ ID NO: 865 - protein, 67 aa, Artificial Sequence
  Synthetic amino acid sequence
AVTGLQTIDSKKYYFNTNTAEAATGWQTIDGKKYYFNTNTAEAATGWQTIDGKKYYFNTNTAIASTG

SEQ ID NO: 866 - protein, 17 aa, Artificial Sequence
  Synthetic amino acid sequence
AATGWQTIDGKKYYFNL

SEQ ID NO: 867 - protein, 19 aa, Artificial Sequence
  Synthetic amino acid sequence
AVTGWQTINGKKYYFNTNT

SEQ ID NO: 868 - protein, 41 aa, Artificial Sequence
  Synthetic amino acid sequence
AATGWQTIDGKKYYFNLNTAEAATGWQTIDGKKYYFNTNTF

SEQ ID NO: 869 - protein, 31 aa, Artificial Sequence
  Synthetic amino acid sequence
TGWQTIDGKKYYFNTNTAIASTGYTIINGKH

SEQ ID NO: 870 - protein, 63 aa, Artificial Sequence
  Synthetic amino acid sequence
WQTIDGKKYYFNLNTAEAATGWQTIDGKKYYFNLNTAEAATGWQTIDGKKYYFNTNTFIASTG

SEQ ID NO: 871 - protein, 8 aa, Artificial Sequence
  Synthetic amino acid sequence
VNRKQLEK

SEQ ID NO: 872 - protein, 8 aa, Artificial Sequence
  Synthetic amino acid sequence
FRTQEDEY

SEQ ID NO: 873 - protein, 11 aa, Artificial Sequence
  Synthetic amino acid sequence
LFESIEKPSSV

SEQ ID NO: 874 - protein, 15 aa, Artificial Sequence
  Synthetic amino acid sequence
FESVLASKSDKSEIF

SEQ ID NO: 875 - protein, 11 aa, Artificial Sequence
  Synthetic amino acid sequence
ESIEKPSSVTV

SEQ ID NO: 876 - protein, 13 aa, Artificial Sequence
  Synthetic amino acid sequence
VQSSFESVLASKS

SEQ ID NO: 877 - protein, 9 aa, Artificial Sequence
  Synthetic amino acid sequence
WINKEESII

SEQ ID NO: 878 - protein, 5 aa, Artificial Sequence
  Synthetic amino acid sequence
ITPVY

SEQ ID NO: 879 - protein, 11 aa, Artificial Sequence
  Synthetic amino acid sequence
NVNINDLSIRY

SEQ ID NO: 880 - protein, 14 aa, Artificial Sequence
  Synthetic amino acid sequence
NFSDKQDVPVSEII

SEQ ID NO: 881 - protein, 5 aa, Artificial Sequence
  Synthetic amino acid sequence
DLSIR

SEQ ID NO: 882 - protein, 9 aa, Artificial Sequence
  Synthetic amino acid sequence
DKQDVPVSE

SEQ ID NO: 883 - protein, 16 aa, Artificial Sequence
  Synthetic amino acid sequence
IETGWIYDMENESDKY

SEQ ID NO: 884 - protein, 11 aa, Artificial Sequence
  Synthetic amino acid sequence
GVFNTPDGFKY

SEQ ID NO: 885 - protein, 4 aa, Artificial Sequence
  Synthetic amino acid sequence
TGSV

SEQ ID NO: 886 - protein, 9 aa, Artificial Sequence
  Synthetic amino acid sequence
VTINDKVFY

SEQ ID NO: 887 - protein, 12 aa, Artificial Sequence
  Synthetic amino acid sequence
IDDNGIVQIGVF

SEQ ID NO: 888 - protein, 454 aa, Artificial Sequence
  Synthetic amino acid sequence
QLQLQESGPGLVKPSETLSLICTVSGGSFSSSDFYWGWIRQPPGKGLEWIGNFYYNGSTSYNPSLKSRVTISVDTSKNQFSLKLRSVTAADTAVYYCARDYNFWNNSPNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 889 - protein, 214 aa, Artificial Sequence
  Synthetic amino acid sequence
EIVMTQSPATLSVSPGERATLSCRASQSISSNLAWYQQKLGQAPRLLIHGASTRATGIPARFSGSGSGTQFTLTISSLQSEDFAVYFCQQYNNWPPTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 890 - protein, 458 aa, Artificial Sequence
  Synthetic amino acid sequence
QVQLVESGGGLVQPGGSLRLSCAASGFTFSSYAMSWVRQAPGKGPEWVSNIIGSGGSTYFTDSVKGRFTISRDNSKNTVYLQMNSLRAEDTAVYYCAKEGCRGYDSGNYFAPKMFCLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 891 - protein, 216 aa, Artificial Sequence
  Synthetic amino acid sequence
NFMLTQPASVSGSPGQSITISCTGTSSDIGAYNYVSWYQQHPGTAPKLMIYEVSHRPSGVSNRFSGSKSGDTASLTISGLQAEDEADYYCSSYTTSITYVFGTGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 892 - protein, 458 aa, Artificial Sequence
  Synthetic amino acid sequence
EVQLVESGGGVVQPGRSLRLSCAASGFTFSSYAMHWVRQAPGKGLEWVAVISKDGDNKYYTDPLKGRFTISRDNSKNTLYLQMISLRGEDTAVYYCARDLNIWSGYYLRTINYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 893 - protein, 213 aa, Artificial Sequence
  Synthetic amino acid sequence
DIVMTQSPSFLSASVGDRVTITCRASQGIRNDLGWYQQKPGKAPKLLIYAASTLQSGVPSRFSGSGSGTEFTLTISSLQPEDFATYYCQQPGSHPPFGGGAKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 894 - protein, 454 aa, Artificial Sequence
  Synthetic amino acid sequence
QVQLQESGPGLVKPSGTLSLTCAVSGGSISSINWWSWVRQPPGKGLEWIGEIYHSGSTNYNPSLKSRVTISVDKSKNQFSLKLSSVTAADTAVYYCAREGKVDSSSQGNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 895 - protein, 217 aa, Artificial Sequence
  Synthetic amino acid sequence
QPVLTQPRSVSGSPGQSVTISCTGTSSDVGGYNYVSWYQQHPGKAPKFMIYDVSKRPSGVPDRFSGSKSGNTASLTISGLQAEDEADYYCCSYAGTYTFYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 896 - protein, 449 aa, Artificial Sequence
  Synthetic amino acid sequence
EVQLVESGPGLVKPSETLSLTCAVSGGSISGYYWSWIRQPPGKGLEWIAYIYDSGSTSHNPSLKSRVTTSVDTSKNQFSLKLNSVTAADTAVYYCARSGKWALGAFDMWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 897 - protein, 218 aa, Artificial Sequence
  Synthetic amino acid sequence
QSALTQPPSVSGAPGQRVTISCTGSSSNIGAGYDVHWYQQLPGTAPKLLISGNNNRPSGVPDRFSGSKSGTSASLAITGLQAEDEADYYCQSYDNDLSGLVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 898 - protein, 449 aa, Artificial Sequence
  Synthetic amino acid sequence
QVQLQESGPGLVKPSQTLSLTCSVSGDSSSSGDYYWNWIRQPAGKGLEWIGYIYTSGSTNYNPSLKSRVTISEDTSKKQFSLKLTSVTAADTAVYYCARGIVGVGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 899 - protein, 212 aa, Artificial Sequence
  Synthetic amino acid sequence
EIVMTQSPSTLSASVGDRVTITCRASQTISSWLAWYQQKPGRAPKLLMSKTSTLQPGVPSRFSGSGSGTEFTLTISGLQPDDVATYYCHHYNSWPFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 900 - protein, 449 aa, Artificial Sequence
  Synthetic amino acid sequence
QVQLRESGPGLVKPSETLSLTCTVSGGSVSNYYWSWIRQPPGKGLEWIGYIYSSGTINFNPSLKGRVTISGDTSKNQFSLKLSSVTAADTAVYYCARSGKWALGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 901 - protein, 218 aa, Artificial Sequence
  Synthetic amino acid sequence
QSALTQPPSVSGAPGQRVTISCTGSSSNIGTGYDVHWYQQLPGKVPKLLIHGNGDRPSGVPDRFSASKSGTSASLAITGLQSEDEGDYYCQSYDNSLSGLVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 902 - protein, 447 aa, Artificial Sequence
  Synthetic amino acid sequence
QVQLVESGGGLVKPGGSLRLSCAASGFTFSTSSMNWVRQAPGKGLEWVSSINTSGDYIYYTDSVKGRFTISRDNAKNSLYLQMNSLRAEDTAVYYCARDLGTWRDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 903 - protein, 218 aa, Artificial Sequence
  Synthetic amino acid sequence
QSVLTQPASVSGSPGQSITISCTGTSSDVGSYNLVSWYHQHPGKAPKLIIYEVSKRPSGVSNRFSGSKSGNTASLTISGLQAEDEADYYCYSYAGSSAFAWVFGTGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 904 - protein, 452 aa, Artificial Sequence
  Synthetic amino acid sequence
QVQLVQSGAEVKKPGASVKLSCQASGYTFPSYYVHWVRQAPGQGLEWMGIINPNGGVTSYAKKFQGRITVTGDTCCTTVHMELNSLTSEDTAVYYCVRVLTVADPPWALDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 905 - protein, 216 aa, Artificial Sequence
  Synthetic amino acid sequence
QAVVTQPASVSGSPGQSITISCTGTSSDVGNYYLVSWYQQHPGKVPKLMIYEVNKRPSGVSDRFSGSKSGSTASLTISGLQAEDEADYYCSSYGGRSTLLFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 906 - protein, 460 aa, Artificial Sequence
  Synthetic amino acid sequence
QLQLQESGPGLVKPSETLSLTCTVSGGSISSYYWSWIRQPAGKGLEWIGRIYTSGSTNYNPSLKSRVTISVDKSKNQFSLKLSSVTAADTAVYYCARDHPTYYDFWSGKYYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 907 - protein, 213 aa, Artificial Sequence
  Synthetic amino acid sequence
QSVLTQPPSVSVSPGQTARITCSGDALPKQYAYWYQQKPGQAPVLVIYKDSERPSGIPERFSGSSSGTTVTLTISGVQAEDEADYYCQSADSSGTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 908 - protein, 451 aa, Artificial Sequence
  Synthetic amino acid sequence
QVQLVQSATEMKKPGASVKVSCKASGYTFSDSYMHWVRQAPGQGLEWMGWINPDSGGTNYAQKFKGWVTMTRDTSINTVYMELRRLRSDDTAVYYCARDGGDYARHSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 909 - protein, 214 aa, Artificial Sequence
  Synthetic amino acid sequence
DVVMTQSPGTLSLSPGERVTLSCRASQSVNSDYLVWYQQKPGQAPRLLIYGASSRATGIPDRFSGSGSGPDFTLTISRLEPEDVAVYYCQLYGGLFTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 910 - protein, 451 aa, Artificial Sequence
  Synthetic amino acid sequence
QVQLVQSGAEVKKPGASVKVSCKASGYTFSDSYMHWVRQAPGQGLEWMGRINPNSGGTNYAQKFQGRVTMTRDTSIKTVYMELSRLRSDDGAIYYCARGMGRTTTGLFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 911 - protein, 214 aa, Artificial Sequence
  Synthetic amino acid sequence
DIVMTQSPATLSLSPGERATLSCKANESVGSYLVWYQQKFGQAPRLLIYDASNRATGIPARFSGSGSGTDFTLTISSLEPEDFAVYYCQQRSNWPPTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 912 - protein, 449 aa, Artificial Sequence
  Synthetic amino acid sequence
QVQLVQSGAEVKKPGASVTVSCRTSGYTFTNDYVHWVRQAPGQGLEWVGLINPSGGNTVYAQSFQGRVTMTRDTSTSTVYMELSSLRSEDTAVYYCARVVHDYGKFDPWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 913 - protein, 216 aa, Artificial Sequence
  Synthetic amino acid sequence
SYELTQPASVSGSPRQSITISCTGTSSDVGNYNLVSWYQQYPGKAPRLIIFEVRQRPSGVSNRFSGSKSGNTASLTISGLQAADEADYYCCSYAGRSIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 914 - protein, 453 aa, Artificial Sequence
  Synthetic amino acid sequence
EVQLVQSGAEVKKPGSSVKVSCKASGGTFRSYAISWVRQAPGQGLEWMGGFIPIPGIRNYAQKFQGRLTISADESTSTGYMELSSLTSEDTAVYYCARGLGRVSHYFYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 915 - protein, 220 aa, Artificial Sequence
  Synthetic amino acid sequence
EIVMTQSPDSLAVSLGERATINCKSSQTVLYSSNNKNYLAWYQQKPGQPPKLLIYWASTRESGVPDRFSGSGSGTDFTLTISNLQAEDVAIYYCQQYYSTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 916 - protein, 454 aa, Artificial Sequence
  Synthetic amino acid sequence
QVQLVQSGAEVKKPGASVKISCKASGYTFVRYYMHWVRQAPGQGLEWMGLIDPSGGSTRYAQRFQGRVTMTRDTSTSTVYMELSGLRSEDTAVYYCARDGPFGGLSGGNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 917 - protein, 215 aa, Artificial Sequence
  Synthetic amino acid sequence
AIRMTQSPGTLSLSPGERATLSCRASQSLSFSYLAWYQQKPGQAPRLLIYGASSRATGIPDRFSGSGSGTDFALTISRLEPEDFAVYYCQQYGTSPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 918 - protein, 455 aa, Artificial Sequence
  Synthetic amino acid sequence
QVQLQESGPGLVKPSETLSLTCTVSGDSISDYYWSWIRQPPGRGLEWIGYIYYSGSTNYNPSLKSRLTISVDTSKNQFSLNLSSVTAADTAVYYCARSMGHYDFWNTYFPCFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 919 - protein, 215 aa, Artificial Sequence
  Synthetic amino acid sequence
EIVMTQSPGTLSLSPGERATLSCRASQSVSSGYLAWYQQKPGQAPRLLIYGASSRATGIPDRFRGSGSGTDFTLTISRLEPEDFAVYYCQQYGSSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 920 - protein, 449 aa, Artificial Sequence
  Synthetic amino acid sequence
EVQLVESGGGLVQPGGSLRLSCAASGFTFSSYEMTWVRQAPGRGLELVSHISGSTIYYADSVKGRFTISRDNAKNSLYLQMNSLRAEDTAIYYCARDGDSGTVVTFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 921 - protein, 214 aa, Artificial Sequence
  Synthetic amino acid sequence
AIRMTQSPSSLSASVGDRVTITCRASQSISNYLNWYQQKPGKAPNLLIYGTSSLQSGVPSRFSGSGSGTDFTLTINSLQPEDFATYYCQQSYSSPCTFGRGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 922 - protein, 456 aa, Artificial Sequence
  Synthetic amino acid sequence
QVQLVQSGAEVKKPGASVKVSCKASGYTFTSYAMHWVRQAPGQRLEWMGWINAGNGNTKYSQEFQGRVTITRDTSASTAYMELSSLRSEDMAVYYCARAHLPGYCSSTSCYIMYVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 923 - protein, 220 aa, Artificial Sequence
  Synthetic amino acid sequence
EIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 924 - protein, 460 aa, Artificial Sequence
  Synthetic amino acid sequence
QVQLVESGPGLVKPSETLSLTCTVSGGSISSSSYYWGWIRQPPGKGLEWIGSIYYSGSTYYNPSLKSRVTISVDTSKNQFSLKLSSVTAADTAVYYCASGPPFYVGWHKYYYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 925 - protein, 220 aa, Artificial Sequence
  Synthetic amino acid sequence
DVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPVTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 926 - protein, 449 aa, Artificial Sequence
  Synthetic amino acid sequence
EVQLVQSGAEVRIPGASVKVSCKASGFTFNDYYIHWVRQAPGQGLEWMGWINAHNGVTSYAQNFQDRVTMTRDTSITTAYMDLSRLRSDDTAVYYCARDCSTSSCFDHWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 927 - protein, 214 aa, Artificial Sequence
  Synthetic amino acid sequence
SYELTQPPSLSVAPGKTAKITCGGNNIGSKGVHWYQQRPGQAPVLVIYYNADRPSGIPERFSGSNSGNTATLTISRVEAGDEADYFCQVWDGDSAHRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 928 - protein, 459 aa, Artificial Sequence
  Synthetic amino acid sequence
QVQLQQSGPGLVKPSQTLSLTCTVSGGSISSGGYYWSWIRQHPGKGLEWIGYIYYSGSTYYNPSLKSRVTISVDTSKNQFSLKLSSVTAADTAVYYCARALRGVSIAARLAHFNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 929 - protein, 213 aa, Artificial Sequence
  Synthetic amino acid sequence
NFMLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTALGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 930 - protein, 448 aa, Artificial Sequence
  Synthetic amino acid sequence
QVQLVQSGGGLVQPGGSLRLSCSASGFTFSSYAMHWVRQAPGKGLEYVSAISSNGGSTYYADSVKGRFTISRDNSKNTLYLQMSSLRAEDTAVYYCVRAAAGNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 931 - protein, 214 aa, Artificial Sequence
  Synthetic amino acid sequence
AIRMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 932 - protein, 452 aa, Artificial Sequence
  Synthetic amino acid sequence
QVQLVQSGGGVVQPGRSLRLSCAASGFTFSQYSIHWVRQAPGKGLEWVAVMSYDGRNKYYADSVKGRFTISGDNSRNTLYVQMNSLRAEDTAIYYCARDLIKAAMVPAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 933 - protein, 213 aa, Artificial Sequence
  Synthetic amino acid sequence
TALTQPRSVSGSPGQSVTISCTGTNSDVADYNYVSWYQHHPGKAPKLMIYDVTKRPSGVPDRFSGSKSGNTASLTISGLQAEDEADYYCCSYAARYTFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 934 - protein, 451 aa, Artificial Sequence
  Synthetic amino acid sequence
QVQLVQSGGGVVQPGRSLRLSCAASGFSFSTHGMHWVRQAPGKGLEWVAVISYDGSNKYYADSVKGRFTISRDNSKNTVYLQMNSLRAEDTAVFYCAKPRDNYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 935 - protein, 214 aa, Artificial Sequence
  Synthetic amino acid sequence
AIRMTQSPSSLSASTGNRVTITCRASQGISSYLAWYQQKPGKAPNLLIYAASTLQSGVPSRFTGSGSGTDFTLTISRLHSENFATYYCQQYFNYPRTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 936 - protein, 452 aa, Artificial Sequence
  Synthetic amino acid sequence
QVQLVESGPGLVKPSETLFLTCNVSGFSILSSTYYWAWMRQSPGKGLEWIGGIYYTGSTYYTPSLRSRITISLDTSKNQISLNLASVTAADTALYYCARRRHGVVDLYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 937 - protein, 213 aa, Artificial Sequence
  Synthetic amino acid sequence
DIVMTQSPATLSVSPGERATLSCRASQSVGKNLAWYQQKPGEGPSLLIYGAFSRATGIPARFTGSGSGTNFTLTISSLQSEDFAVYYCQQYDHWLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 938 - protein, 445 aa, Artificial Sequence
  Synthetic amino acid sequence
EVQLLESGAEVKKPGESLRISCNCSGYSFTSYWIGWVRQMPGEGLEWMGLIQPGGDSYPRYSPSFQGQVTISADKSISTAYLQWRSLKASDTAMYYCARRGFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 939 - protein, 216 aa, Artificial Sequence
  Synthetic amino acid sequence
NFMLTQPPSASGAPGQRVTISCSGSSSNIGSNTVNWYQQLPGTAPKLLIYSNIQRPSGVPDRFSGSKSGTSASLAISGLQSDDEADYYCSAWDDSLNGYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 940 - protein, 458 aa, Artificial Sequence
  Synthetic amino acid sequence
EVQLVETGPGLVKPSETLSLTCTVSGGSISSSSYYWGWIRQPPGKGLEWIGSMSYFGSTHYNPSLKSRVTISVDTSKNQFSLKLSSVTAADTAVYYCARHKVIKNYYNNYVLGYFDYWGQGMLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 941 - protein, 216 aa, Artificial Sequence
  Synthetic amino acid sequence
EIVLTQSPGTLSLSPGERATLSCRASQSVSSSYLAWYQQKPGRAPRLLIYGASSRATGIPDRFSGSGSGTDFTLTISRLEPEDFAVYYCQQYGSAPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 942 - protein, 452 aa, Artificial Sequence
  Synthetic amino acid sequence
QVQLVQSGAQVKKPGSSVKVSCKASGYAFISYGITWVRQAPGQGLEWMGWISAYNGDTNYAQKFQGRVTMTTDTSTNTAYMELRSLRSDDTAVYYCARALTRVAVALPHPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 943 - protein, 220 aa, Artificial Sequence
  Synthetic amino acid sequence
EIVLTQSPDSLAVSLGERATINCKSSQSVLYSSNNKNYLTWYQQKPGQPPKLLIYWASTRESGVPDRFSGSGSGTDFTLTISSLQAEDVAVYYCQQYYSTPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 944 - protein, 459 aa, Artificial Sequence
  Synthetic amino acid sequence
EVQLLESGAEVKKPGASIRVSCKASGHSFTDSFTDYYFHWVRQAPGQGLEWMGMINPSVGSTNYAQKFQGRVTLTRDTSTHTVYMELSSLRSEDTAVYFCARDPWFCSRGTSCYYFGLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 945 - protein, 214 aa, Artificial Sequence
  Synthetic amino acid sequence
DIQLTQSPSSLSASVGDSVTITCRASQSISTYLNWYQQKPGKAPKLLIYDASSLLSGVPSRFSGGGSGTDFTLTISSLQPEDFATYYCQQSDISPPVFGRGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 946 - protein, 453 aa, Artificial Sequence
  Synthetic amino acid sequence
EVQLVESGAEVKRPGASVKVSCRTSAYAFTNYFMHWVRQAPGQGLEWVAVINLSGGNTNYAQSFQGRVNMTRDTSTSTVYMELSSLRSEDTAVYFCAIGGIWFGEYPNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 947 - protein, 216 aa, Artificial Sequence
  Synthetic amino acid sequence
NFMLTQPPSVSAAPGRKVTVSCSGSSSNIGNNYVSWYQQFPGTAPKLLIYDNNKRHSGIPARFSGSKSGTSATLGITGLQTGDEADYYCATWDSSLKYVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 948 - protein, 450 aa, Artificial Sequence
  Synthetic amino acid sequence
QVQLVQSGPRLVKPSGTLSLTCAVSGASITSSNWWSWVRQPPGEGLEWIGEIHHSGGITYNPSLMGRVTISLDKSKNSFSLVVTSVTAADTAFYFCARSGRGQLGLPDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 949 - protein, 220 aa, Artificial Sequence
  Synthetic amino acid sequence
DVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPFFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 950 - protein, 445 aa, Artificial Sequence
  Synthetic amino acid sequence
QVQLQESGPGLVKPSETLSLTCTVSGGSISSHYWSWIRQTPGKGLEYIGNIYYTGRTKYNPSLKSRVTISADMSKNQVSLKLNSVTAADTAVYYCARGGPLMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 951 - protein, 215 aa, Artificial Sequence
  Synthetic amino acid sequence
DIVMTQSPATLSVSPGERATLSCRASQSISSNLAWYQQKPGQAPRLLIYGASTRATGIPARFSGSGSGTEFTLTISSLQSEDFAIYYCQQYSNWPLWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 952 - protein, 446 aa, Artificial Sequence
  Synthetic amino acid sequence
QVQLVQSGGGLVQPGGSLRLSCVASGFTFSSYAMTWVRQAPGMGLEWVSTISLSGSTIYYADSVKGRFTISRDNPKNTLYLQMNSLRAEDTAVYYCAEGQGAFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 953 - protein, 216 aa, Artificial Sequence
  Synthetic amino acid sequence
NFMLTQPPSASGTPGQRVTISCSGSTSNIGGNTVNWYQQLPGTAPKLLIYSNIQRPSGVPDRFSGSKSGTSASLAIRGLRSEDEADYYCSTWDDSRKGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 954 - protein, 451 aa, Artificial Sequence
  Synthetic amino acid sequence
QVQLVESGGDLIQPGESLRLSCVASGFTVGSHYMTWVRQAPGKGLEWVSTIYSGGTTKYADSVKGRFTISRDNSKNTLFLQMNSLRTEDTAVYFCARGSAFSSSWWLVDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 955 - protein, 214 aa, Artificial Sequence
  Synthetic amino acid sequence
SYELTQPPSVSVAPGKTARITCEDNYVGGNNVHWYQQKPGQAPVLVVSDDNARPSGIPERVSGSKSGNTATLIINRVEVGDEADFYCQVWDSSRDRVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 956 - protein, 458 aa, Artificial Sequence
  Synthetic amino acid sequence
EVQLVQSGGGVVQPGRSLKLSCAASGFSFSSHGMHWVRQAPGKGLEWVALISYDGSYKYYEDSVKGRFTISRDNSKNTLYLQMNSLRAEDTAVYYCAKDWERYCSGMSCYLRNSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 957 - protein, 214 aa, Artificial Sequence
  Synthetic amino acid sequence
QSALTQPPSVSVAPGKTAGITCGGPNIGSKSVHWYQRKPGQAPVLVVYDDRYRPSGIPERFSGSNSGNTATLSISRVEAGDEADYYCQVWDSRSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 958 - protein, 454 aa, Artificial Sequence
  Synthetic amino acid sequence
QVQLVQSGGGLVQPGRSLRLSCAASGFAFDDYALHWVRQVPGKGLEWVSGISWNSDSIAYADSVKGRFTISRDNAKNSLYLQMNGLRAEDTALYYCAKDRTIASAGIPDEFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 959 - protein, 214 aa, Artificial Sequence
  Synthetic amino acid sequence
DIVMTQSPATLSVSPGERATLSCRASQSVSYKVAWYQQKPGQAPRLLIYGASTRDTGIPARFSGSGSGTDFTLTISSLQSEDSAVYYCQQYSNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 960 - protein, 450 aa, Artificial Sequence
  Synthetic amino acid sequence
QVQLLESGPGLVKTSGTLSLTCSVSGDSVSTNNWWTWVRQPPGKGLEWIGEIYYNGNTIYNPSFKSRVTISVNRSKNHFSLKLNSVTAADRAVYYCARRTWNDVGPFDYWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 961 - protein, 216 aa, Artificial Sequence
  Synthetic amino acid sequence
DIVMTQSPSSLSASIGDRVIITCRASQNINRYLNWYQQTAGKAPKLLIYGTSNLQSGVPSRFSGSGSGSGTDFTLTISSLQPEDFATYYCHQSYRTPQTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 962 - protein, 454 aa, Artificial Sequence
  Synthetic amino acid sequence
QVQLVESGPALVKPTQTLTLTCTFSGFSLSSIGMCVSWIRQPPGKALEWLARIDWDDSKYYSPSLQARLAISKDTSKNQVVLTMTNVDPMDAGTYYCARTSATLTGPSRVFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 963 - protein, 215 aa, Artificial Sequence
  Synthetic amino acid sequence
DVVMTQSPATLSVSPGERATLSCRASQSVRFNLAWYQQKPGQAPRLLISGASTRATGIPARFSGSGSGTEFTLTISSLQSEDFAVYYCQQYNNWPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 964 - protein, 460 aa, Artificial Sequence
  Synthetic amino acid sequence
QVQLQESGPGLVKPSETLSLTCTLSGGSISSDNYYWGWVRQPPGKGLEWIGSIYYSGSTYYNPSLKSRVFISVDMSKNQFSLKLSSVTAADTAVYYCARHTQGLGILRYFDWWTRPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 965 - protein, 213 aa, Artificial Sequence
  Synthetic amino acid sequence
DIQMTQSPSSLSASVGDRVTITCRASQNINTYLSWYRQKPGKAPELLIYAASNLQSGVPSRFSGSGSGTDFTLTIHSLQPEDFATYYCQQSYTTLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 966 - protein, 449 aa, Artificial Sequence
  Synthetic amino acid sequence
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAGTLRGRGAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 967 - protein, 214 aa, Artificial Sequence
  Synthetic amino acid sequence
EIVMTQSPSSLSASVGDRVTITCRASQSISSYLNWYQQKPGKAPKLLIYAASSLQSGVPSRFSGSGSGTDFTLTISSLQPEDFATYYCQQSYSTPVTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 968 - protein, 466 aa, Artificial Sequence
  Synthetic amino acid sequence
QVQLQESGPGLVKPSQTLSLTCTVSGDSISSNQYYWTWIRQPAGKGLEWIGQIESAYFTNYNPSLKGRVTISGDASKNVLSLTLTSVTAADTALYWCAREAGGGLGYCTGGRCQFSGYYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 969 - protein, 216 aa, Artificial Sequence
  Synthetic amino acid sequence
QSALTQPPSVSAAPGQTVTISCSGSHSNIGNNYVSWYQQLPGTAPRRLIYDTDKRPSGIPDRFSGSKSGTSATLVITGLRAGDEADYYCGTWDGSLSAGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 970 - protein, 446 aa, Artificial Sequence
  Synthetic amino acid sequence
QVQLQQSGPGLVKPSETLSLTCTVSGGSISSQYWSWIRQPPGKGLEWIGYIYYSGGTNYNPSLKSRVTISVDTSKNQFSLKLTSVTAADTAVYYCARDYFYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 971 - protein, 214 aa, Artificial Sequence
  Synthetic amino acid sequence
DIVMTQSPGTLSLSPGERATLSCRASQSVDSSFLAWYQQKPGQAPRLLIYGASSRATGIPDRFSGSGSETDFTLTISRLEPEDFAVYYCQQYGSSRSFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 972 - protein, 458 aa, Artificial Sequence
  Synthetic amino acid sequence
QVQLVQSGPVLVKPTETLMLTCTVSGFSLSSAGMGVSWIRQPPGKAPEWLAHIFLSDEKSYRTSLESRLTISKDTSKSQVVLIMTNVDPADTATYYCARALKRYCTGGVCFLNWFDSWGPGTVVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 973 - protein, 215 aa, Artificial Sequence
  Synthetic amino acid sequence
DIVMTQSPGTLSLSPGERATLSCRASLSIGNLYLAWYKQRPGHPPRLLIYGASSRATGTPDRFSGSGSGTDFTLTISRLEPEDFVVYYCQQYKTSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 974 - protein, 452 aa, Artificial Sequence
  Synthetic amino acid sequence
QITLKESGPALVKPTQTLKLTCTFSGFSLSTTGMCVTWIRQPPGKALEWLARIDWDDNTYYSTSLKTRLTITKDTSNNQVVLTMTNMDPMDTATYYCARMIPPPHRGAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 975 - protein, 215 aa, Artificial Sequence
  Synthetic amino acid sequence
EIVLTQSPATLSVSPGERVTLSCRASQSVRGNLAWYQQKPGQVPRLLIFGASTRATGIPARFSGSGSGTEFTLTISSLQSEDFAVYYCQQYNKWPPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 976 - protein, 452 aa, Artificial Sequence
  Synthetic amino acid sequence
QVQLVQSGPEVRKPGTSVKFSCKASGFTFTSAAMQWVRQARGQRLEWIGWIVVDSGNTNYAQKFQERVTITRDMSTSTVYMELSSLRSEDTAMYYCAASRGIVGTRGLFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 977 - protein, 214 aa, Artificial Sequence
  Synthetic amino acid sequence
EIVLTQSPSSLSSSVGDRVTITCRASQSIRNYLNWYQQKPGKAPKLLIYGASSLQSGVPPRFSGSGFGTDFTLTISNLQPEDFASYSCQQTYSTPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 978 - protein, 453 aa, Artificial Sequence
  Synthetic amino acid sequence
EVQLVESGGGLVQPGGSLRLSCAASGFTVSRNYMTWVRQAPGKGLEWVSVIYSGGSTYHADSVKGRFTISRDNSKNTLNLQMSSLRAEDTAVYYCARPCPGSSISCDYNMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 979 - protein, 217 aa, Artificial Sequence
  Synthetic amino acid sequence
QAVVTQPASVSGSPGQSITISCTGTSSDVGGYNYVSWYQQHPGKAPKLIIYEVSNRPSGVSNRFSGSKSGNTASLTISGLQAEDEADYYCTSYTSSSMIDVFGTGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 980 - protein, 465 aa, Artificial Sequence
  Synthetic amino acid sequence
QVQLQESGAEVKKPGSSVKVSCQASGGTFSNYAFNWVRQAPGQGLEWMGRTIPIVGLVNYAQNFQGRITFSADKSTSTAYMEVNSLRSDDTAVYYCARAEYPLNCTRGNCDVGTSYHYYYGMGVWGRGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 981 - protein, 214 aa, Artificial Sequence
  Synthetic amino acid sequence
EIVMTQSPATLSVSPGERATLSCRASQSISSNLAWFQQKPGQAPRLLIHGASTRATGIPVRFSGSGSGTEFTLTISSLQFGDSAVYYCQQYYNWRYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 982 - protein, 453 aa, Artificial Sequence
  Synthetic amino acid sequence
QVQLVQSGAEVKKPGASVKVSCKASGYTFTTYAMHWVRQAPGHRLEWMGWINPVNGNSKHSQNFQGRVTITRDTSASTVYMELSSLRSEDTAVYYCARDTSSGVILANNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 983 - protein, 214 aa, Artificial Sequence
  Synthetic amino acid sequence
DIVMTQSPATLSLSPGERATLSCRASQSVDSYLTWYQQKPGQAPRLLIYDSSNRATGIPARFSGSGSGTDFTLTISSLEPEDFAVYYCHQRSNWPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 984 - protein, 456 aa, Artificial Sequence
  Synthetic amino acid sequence
QVQLQESGPRLLEPSETLSLSCTVSGGSITSYYWGWIRQSPGKGLQWIGHIDSSGNTNYNYNSSLMNRVTISVVTSKNQFSLKLTSVTPADSAVYYCARVYLFYFGQSKWEYFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 985 - protein, 218 aa, Artificial Sequence
  Synthetic amino acid sequence
QSALTQPPSVSGAPGQRVTISCTGSDSNIGTDYDVHWYKQVPGAAPKLLIYGINNRPSGVPDRFSGSKSGTSASLAITGLQAEDEGDYYCQSYDIRPSGSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 986 - protein, 451 aa, Artificial Sequence
  Synthetic amino acid sequence
QVQLVQSGTEVKKPGASVKVSCKASGYTFTNYGISWVRQAPGQGLEWMGWISGNNGHTNYAQNLQGRVTMTTDTSTSTAYMELRSLRSDDTAVYYCARVTRWFGELLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 987 - protein, 217 aa, Artificial Sequence
  Synthetic amino acid sequence
QTVVTQEPSLTVSPGGTVTLTCASSTGAVTSGFLPNWFQQKPGQAPRALIYNTNNKHSWTPARFSGSLLGGKAALTLSGVQPEDEAEYYCLLYFDDAQVQVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 988 - protein, 457 aa, Artificial Sequence
  Synthetic amino acid sequence
EVQLLESGGGVVQPGRSLRLSCAASGFTFSNYGMHWVRQAPGKGLEWVAVIWYDGSNKYYADSVKGRFTISRDNSKNMVYLQMNSLRGADTAVYYCAGDRHLGLWGYYYYYYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 989 - protein, 216 aa, Artificial Sequence
  Synthetic amino acid sequence
QAVVTQPPSVSAAPGQRVTISCSGSSSNIGKNYVSWYQHLPGTAPKLLIYESNKRPSGIPDRFSGSKSGTSATLGITGLQTGDEADYYCGTWDSSLSAGLFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 990 - protein, 454 aa, Artificial Sequence
  Synthetic amino acid sequence
EVQLVESGGGLVQPGRSLRLSCAASGFTFDDYAMHWVRQAPGKGLEWVSGISWNSDSIAYADSVKGRFTISRDNAKNSLYLQMNSLRAEDTALYYCAKDWGIAGAGIPDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 991 - protein, 215 aa, Artificial Sequence
  Synthetic amino acid sequence
QAVVTQPPSASGTPGQRVTISCSGSNSNIGSNTVNWYQQLPGTAPKLLIYDNNQRPSGVPDRFSASKSGASASLAISGLQSEDEADYYCAAWDNNLNGLFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 992 - protein, 460 aa, Artificial Sequence
  Synthetic amino acid sequence
QVQLQQSGPGLVKPSETLSLTCTLSGGSISSDNYYWGWVRQPPGKGLEWIGSIYYSGSTYYNPSLKSRVFISVDMSKNQFSLKLSSVTAADTAVYYCARHTQGLGILRYFDWWTRPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 993 - protein, 215 aa, Artificial Sequence
  Synthetic amino acid sequence
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 994 - protein, 453 aa, Artificial Sequence
  Synthetic amino acid sequence
QVQLVESGAEVKKPGASVKVSCKASGYTFTSYDINWVRQATGQGLEWMGWMNPNSGNTGYAQKFQGRVTMTRNTSISTAYMELSSLRSEDTAVYYCARGGPNSGSFSHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 995 - protein, 222 aa, Artificial Sequence
  Synthetic amino acid sequence
QAVVTQPPSASASLGASVTLTCTLSSGYSNYKVDWYQQRPGKGPRFVMRVGTGGIVGSKGDGIPDRFSVLGSGLNRYLTIKNIQEDDESDYHCGADHGSGSNFAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 996 - protein, 451 aa, Artificial Sequence
  Synthetic amino acid sequence
EVQLLESGAEVKKPGASVKVSCKASAYTFTTYGINWVRQAPGQGLEWMGWVSFSNGNTEYAQKFQGRVTMTTDTSTSTAFMELRSLRSDDTAVYYCASEKGELLSGCFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 997 - protein, 216 aa, Artificial Sequence
  Synthetic amino acid sequence
QSVLTQPPSVSAAPGQKVTISCSGSSSNIGNSLVSWYQHLPGTAPKLLISDNNERPSGIPDRFSGSKSGTSATLGITGLQTGDEADYYCGTWDSSLSVVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 998 - protein, 457 aa, Artificial Sequence
  Synthetic amino acid sequence
QVQLVQSGAEVKKPGASVKVSCKVSGYTLPELSMHWVRQAPGKGLEWMGGFDPEDDDTIYAQKFQGRVTMTEDTSTDTAYLELSSLRSEDTAVYYCATDSSPLYNENYFGSAAFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 999 - protein, 214 aa, Artificial Sequence
  Synthetic amino acid sequence
AIRMTQSPSSLSASVGDRVTITCRASQGISTYLAWYQQKPGKAPKLLLYAASRLESGVPSRFSGSGSGTDYTLTINSLQPEDFATYYCQQYDRMPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1000 - protein, 450 aa, Artificial Sequence
  Synthetic amino acid sequence
QVQLVESGAEVKKPGASVKVSCKASGYTFTGYYMHWVRQAPGQGLEWMGWINPNSGGTNYAQKFQGRVTMTRDTSISTAYMELSRLRSDDTAVYYCAREGTWGVSAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1001 - protein, 214 aa, Artificial Sequence
  Synthetic amino acid sequence
DIVMTQSPGTLSLSPGERATLSCRASQSVSSSYLAWYQQKPGQAPRLLIYGASSRATGIPDRFSGSGSGTDFTLTISRLEPEDFAVYYCQQYGSSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1002 - protein, 450 aa, Artificial Sequence
  Synthetic amino acid sequence
QVQLVESGGGVVQPGRSLRLSCAASGFVFSSYGMHWVRQAPGMGLEWVAIISYDGSNKYYADSVKGRFTISRDNSKNRLYLQMSSLRADDSAVYYCAKDLDDSNALADYWGLGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1003 - protein, 215 aa, Artificial Sequence
  Synthetic amino acid sequence
DILLTQSPSSLAAIVGDRVTISCRASQAINSALAWYQQRPGKAPKLLLYGRSRLNSGVSSRFSGSGSGTDYTLTISSLQPEDFATYYCQQYYSNPPWTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1004 - protein, 449 aa, Artificial Sequence
  Synthetic amino acid sequence
QVQLVESGGGLVQPGRSLRLSCRTSGFTFGDFALSWVRQAPGKGLEWVGYIRSKTFGGTTEYAASVKGRFTMSRDDSKSIAYLQMNSLKTEDTAVYFCTRASYGAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1005 - protein, 214 aa, Artificial Sequence
  Synthetic amino acid sequence
DIVMTQSPSSLSASVGDTVTITCRAGQNIATYLHWYQQKPGKAPNLLIYDARTLQSGVPSRFSGSGSGTDFTLTINSLQPEDFATYYCQQSYNTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1006 - protein, 448 aa, Artificial Sequence
  Synthetic amino acid sequence
QVQLQQSGAEVKRPGASVIVSCKASGYTFSGYYINWVRQAPGQGLQWMGWIDPSSGETHYVEKFRGRVAMTRDLSLSTTYMDLSRLRSDDTALYYCARVVDAHHIDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1007 - protein, 215 aa, Artificial Sequence
  Synthetic amino acid sequence
DVVMTQSPGTLSLSPGERATLSCRASQRISSSFLAWYQQKPGRAPRLLIYVASNRATGIPDRFSGSGSGTDFTLTISRLEPEDFAVYFCLQYGDSPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1008 - protein, 446 aa, Artificial Sequence
  Synthetic amino acid sequence
QVQLQESGPGLMKPSETLSLTCTVSGGSITDDYWSWIRQPPGKGLEWIGYIYYTGSSNYNPSLKSRVTISVDTSKNQFSLNLSSVTAADTAVYYCARHSHGGFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1009 - protein, 214 aa, Artificial Sequence
  Synthetic amino acid sequence
DIQMTQSPSSLSASVGDRVTVTCRASQDISNSLAWYQQKPGKAPLLLLYAASTLESGVPSRFSGSGSGTDYTLTISSLQPEDFATYYCQQYYNTQYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1010 - protein, 448 aa, Artificial Sequence
  Synthetic amino acid sequence
EVQLVESGGGLVKPGGSLKLSCAASGFSFSTYTMNWVRQIPGKGLEWISSISSSTNYIYYADSVKGRFTISRDNTKNSLHLQMNSLRAEDTAVYYCARVNPLRYFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1011 - protein, 214 aa, Artificial Sequence
  Synthetic amino acid sequence
DIVMTQSPSSLSASVGDRVTITCRASQRIATYLSWYQQKPGKAPKLLIFDASTLQSGVPSRFSGSGSGTDFTLTISGLQPEDLATYYCQQSSSTHLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1012 - protein, 457 aa, Artificial Sequence
  Synthetic amino acid sequence
QVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDRKRYCSSTSCQRSGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1013 - protein, 214 aa, Artificial Sequence
  Synthetic amino acid sequence
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1014 - protein, 456 aa, Artificial Sequence
  Synthetic amino acid sequence
QVQLQESGPGLVKPSETLSLTCSVSGGSVKSSYWNWIRQSPGKEPEWIGYIYYTGSTNYNPSLKSRVTMSMDTSKNQFSLKLSSVTAADTAVYYCARVFGVRDYNKGAYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1015 - protein, 216 aa, Artificial Sequence
  Synthetic amino acid sequence
DIVMTQSPGTLSLSPGDRATLSCRASQTLVSNSLAWYQQKPGQAPRLLIYGASTRAIGIPDRFSGGGSGTDFTLTISRLESEDFGMYYCHQSGNSPRGTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1016 - protein, 12 aa, Artificial Sequence
  Synthetic amino acid sequence
FNHLSESKKYGP

SEQ ID NO: 1017 - protein, 19 aa, Artificial Sequence
  Synthetic amino acid sequence
AMEGGSGHTVTGNIDHFFS

SEQ ID NO: 1018 - protein, 11 aa, Artificial Sequence
  Synthetic amino acid sequence
SLENDGTRLLD

SEQ ID NO: 1019 - protein, 13 aa, Artificial Sequence
  Synthetic amino acid sequence
SQINKPTVPTIDD

SEQ ID NO: 1020 - protein, 10 aa, Artificial Sequence
  Synthetic amino acid sequence
LNIYSQELLN

SEQ ID NO: 1021 - protein, 10 aa, Artificial Sequence
  Synthetic amino acid sequence
VNNELILHDK

SEQ ID NO: 1022 - protein, 18 aa, Artificial Sequence
  Synthetic amino acid sequence
FSSPSISSHIPSLSIYSA

SEQ ID NO: 1023 - protein, 17 aa, Artificial Sequence
  Synthetic amino acid sequence
AMEGGSGHTVTGNIDHF

SEQ ID NO: 1024 - protein, 11 aa, Artificial Sequence
  Synthetic amino acid sequence
IVYQSKFLTLN

SEQ ID NO: 1025 - protein, 13 aa, Artificial Sequence
  Synthetic amino acid sequence
FGVDGVKAPGIYG

SEQ ID NO: 1026 - protein, 14 aa, Artificial Sequence
  Synthetic amino acid sequence
LSIYSAIGIETENL

SEQ ID NO: 1027 - protein, 34 aa, Artificial Sequence
  Synthetic amino acid sequence
LNQHLNPAIESDNNFTDTTKIFHDSLFNSATAEN

SEQ ID NO: 1028 - protein, 12 aa, Artificial Sequence
  Synthetic amino acid sequence
IEGQAILYQNEF

SEQ ID NO: 1029 - protein, 11 aa, Artificial Sequence
  Synthetic amino acid sequence
SIYSAIGIETE

SEQ ID NO: 1030 - protein, 11 aa, Artificial Sequence
  Synthetic amino acid sequence
YPISTNINLSK

SEQ ID NO: 1031 - protein, 21 aa, Artificial Sequence
  Synthetic amino acid sequence
KDVLSKIDINKNKLIIGNQTI

SEQ ID NO: 1032 - protein, 4 aa, Artificial Sequence
  Synthetic amino acid sequence
SFEY

SEQ ID NO: 1033 - protein, 14 aa, Artificial Sequence
  Synthetic amino acid sequence
RYLEESNKKILQKI

SEQ ID NO: 1034 - protein, 20 aa, Artificial Sequence
  Synthetic amino acid sequence
SIDFKDIKKLSLGYIMSNFK

SEQ ID NO: 1035 - protein, 22 aa, Artificial Sequence
  Synthetic amino acid sequence
IVYQSKFLTLNGKKYYFDNDSK

SEQ ID NO: 1036 - protein, 22 aa, Artificial Sequence
  Synthetic amino acid sequence
IVYQSKFLTLNGKKYYFDNNSK

SEQ ID NO: 1037 - protein, 37 aa, Artificial Sequence
  Synthetic amino acid sequence
LTLNGKKYYFDNDSKAVTGWRIINNEKYYFNPNNAIA

SEQ ID NO: 1038 - protein, 41 aa, Artificial Sequence
  Synthetic amino acid sequence
LTLNGKKYYFGSDSKAVTGWRIINNKKYYFNPNNAIAAIHL

SEQ ID NO: 1039 - protein, 18 aa, Artificial Sequence
  Synthetic amino acid sequence
GVIYFFGVDGVKAPGIYG

SEQ ID NO: 1040 - protein, 18 aa, Artificial Sequence
  Synthetic amino acid sequence
HLNPAIESDNNFTDTTKI

SEQ ID NO: 1041 - protein, 15 aa, Artificial Sequence
  Synthetic amino acid sequence
LLDASVSPDTKFILN

SEQ ID NO: 1042 - protein, 11 aa, Artificial Sequence
  Synthetic amino acid sequence
SSTTEALQLLE

SEQ ID NO: 1043 - protein, 11 aa, Artificial Sequence
  Synthetic amino acid sequence
VSEYNRDETVL

SEQ ID NO: 1044 - protein, 12 aa, Artificial Sequence
  Synthetic amino acid sequence
IKQWADINAEYN

SEQ ID NO: 1045 - protein, 18 aa, Artificial Sequence
  Synthetic amino acid sequence
RKINSNHGIDIRANSLFT

SEQ ID NO: 1046 - protein, 5 aa, Artificial Sequence
  Synthetic amino acid sequence
STTEA

SEQ ID NO: 1047 - protein, 11 aa, Artificial Sequence
  Synthetic amino acid sequence
VSEYNRDETVL

SEQ ID NO: 1048 - protein, 31 aa, Artificial Sequence
  Synthetic amino acid sequence
ISIENGTIKKGKLIKDVLSKIDINKNKLIIG

SEQ ID NO: 1049 - protein, 16 aa, Artificial Sequence
  Synthetic amino acid sequence
IVYQSKFLTLNGKKYY

SEQ ID NO: 1050 - protein, 45 aa, Artificial Sequence
  Synthetic amino acid sequence
AIVYQNKFLTLNGKKYYFDNDSKAVTGWQTIDGKKYYFNLNTAEA

SEQ ID NO: 1051 - protein, 15 aa, Artificial Sequence
  Synthetic amino acid sequence
GWQTIDGKKYYFNLN

SEQ ID NO: 1052 - protein, 23 aa, Artificial Sequence
  Synthetic amino acid sequence
SKAVTGWQTINGKVYYFMPDTAM

SEQ ID NO: 1053 - protein, 42 aa, Artificial Sequence
  Synthetic amino acid sequence
AATGWQTIDGKKYYFNTNTAEAATGWQTIDGKKYYFNTNTAI

SEQ ID NO: 1054 - protein, 41 aa, Artificial Sequence; identical to SEQ ID NO: 868
  Synthetic amino acid sequence

SEQ ID NO: 1055 - protein, 18 aa, Artificial Sequence
  Synthetic amino acid sequence
INKSNGESVYVETEKEIF

SEQ ID NO: 1056 - protein, 13 aa, Artificial Sequence
  Synthetic amino acid sequence
LVNLISNAVNDTI

SEQ ID NO: 1057 - protein, 15 aa, Artificial Sequence
  Synthetic amino acid sequence
IKQWADINAEYNIKL

SEQ ID NO: 1058 - protein, 18 aa, Artificial Sequence
  Synthetic amino acid sequence
RKINSNHGIDIRANSLFT

SEQ ID NO: 1059 - protein, 26 aa, Artificial Sequence
  Synthetic amino acid sequence
YFAPANTDANNIEGQAIRYQNRFLHL

SEQ ID NO: 1060 - protein, 33 aa, Artificial Sequence
  Synthetic amino acid sequence
EVRINSEGRKELLAHSGKWINKEEAIMSDLSSK

SEQ ID NO: 1061 - protein, 27 aa, Artificial Sequence
  Synthetic amino acid sequence
TILTNLDEYNKLTTNNNENKYLQLKKL

SEQ ID NO: 1062 - protein, 13 aa, Artificial Sequence
  Synthetic amino acid sequence
FGVDGVKAPGIYG

SEQ ID NO: 1063 - protein, 15 aa, Artificial Sequence
  Synthetic amino acid sequence
YKSQINKPTVPTIDD

SEQ ID NO: 1064 - protein, 12 aa, Artificial Sequence
  Synthetic amino acid sequence
EQELLNIYSQEL

SEQ ID NO: 1065 - protein, 9 aa, Artificial Sequence
  Synthetic amino acid sequence
KPVYEDTNI

SEQ ID NO: 1066 - protein, 8 aa, Artificial Sequence
  Synthetic amino acid sequence
SYPISTNI

SEQ ID NO: 1067 - protein, 13 aa, Artificial Sequence
  Synthetic amino acid sequence
GHTVTGNIDHFFS

SEQ ID NO: 1068 - protein, 7 aa, Artificial Sequence
  Synthetic amino acid sequence
FYAFFDY

SEQ ID NO: 1069 - protein, 23 aa, Artificial Sequence
  Synthetic amino acid sequence
EDISKNNSTYSVRFINKSNGESV

SEQ ID NO: 1070 - protein, 10 aa, Artificial Sequence
  Synthetic amino acid sequence
TGLNTIYDSI

SEQ ID NO: 1071 - protein, 15 aa, Artificial Sequence
  Synthetic amino acid sequence
YKSQINKPTVPTIDD

SEQ ID NO: 1072 - protein, 12 aa, Artificial Sequence
  Synthetic amino acid sequence
EQELLNIYSQEL

SEQ ID NO: 1073 - protein, 10 aa, Artificial Sequence
  Synthetic amino acid sequence
WADINAEYNI

SEQ ID NO: 1074 - protein, 18 aa, Artificial Sequence
  Synthetic amino acid sequence
SLRKINSNHGIDIRANSL

SEQ ID NO: 1075 - protein, 11 aa, Artificial Sequence
  Synthetic amino acid sequence
QLFSTGLNTIY

SEQ ID NO: 1076 - protein, 17 aa, Artificial Sequence
  Synthetic amino acid sequence
SKIDINKNKLIIGNQTI

SEQ ID NO: 1077 - protein, 18 aa, Artificial Sequence
  Synthetic amino acid sequence
TIDGKKYYFNTNTFIAST

SEQ ID NO: 1078 - protein, 20 aa, Artificial Sequence
  Synthetic amino acid sequence
LTLNGKKYYFGSDSKAVTGL

SEQ ID NO: 1079 - protein, 12 aa, Artificial Sequence
  Synthetic amino acid sequence
SGHTVTGNIDHF

SEQ ID NO: 1080 - protein, 9 aa, Artificial Sequence
  Synthetic amino acid sequence
SLENDGTRL

SEQ ID NO: 1081 - protein, 38 aa, Artificial Sequence
  Synthetic amino acid sequence
LTLNGKKYYFDNDSKAVTGWRIINNEKYYFNPNNAIAA

SEQ ID NO: 1082 - protein, 36 aa, Artificial Sequence
  Synthetic amino acid sequence
LTLNGKKYYFDNNSKAVTGWQTIDSKKYYFNTNTAE

SEQ ID NO: 1083 - protein, 38 aa, Artificial Sequence
  Synthetic amino acid sequence
LTLNGKKYYFGSDSKAVTGWRIINNKKYYFNPNNAIAA

SEQ ID NO: 1084 - protein, 21 aa, Artificial Sequence
  Synthetic amino acid sequence
AATGWQTIDGKKYYFNTNTAE

SEQ ID NO: 1085 - protein, 9 aa, Artificial Sequence
  Synthetic amino acid sequence
LVNTLKKAI

SEQ ID NO: 1086 - protein, 18 aa, Artificial Sequence
  Synthetic amino acid sequence
EYNRDETVLESYRTNSLR

SEQ ID NO: 1087 - protein, 11 aa, Artificial Sequence
  Synthetic amino acid sequence
YQFEKYVRDYT

SEQ ID NO: 1088 - protein, 20 aa, Artificial Sequence
  Synthetic amino acid sequence
IVYQSKFLTLNGKKYYFDND

SEQ ID NO: 1089 - protein, 20 aa, Artificial Sequence
  Synthetic amino acid sequence
IVYQSKFLTLNGKKYYFDNN

SEQ ID NO: 1090 - protein, 20 aa, Artificial Sequence
  Synthetic amino acid sequence
IVYQNKFLTLNGKKYYFDND

---

What is claimed is:

1. An antibody or binding fragment thereof comprising a heavy chain variable region comprising the amino acid sequence of SEQ ID NO: 938 and a light chain variable region comprising the amino acid sequence of SEQ ID NO: 939.

2. The antibody or binding fragment thereof according to claim 1, wherein the antibody or binding fragment thereof has a binding affinity (Kd) for *C. difficile* toxin A of 0.06 nM.

3. The antibody or binding fragment thereof according to claim 1, wherein the antibody or binding fragment thereof binds to an epitope of *C. difficile* toxoid A, wherein the epitope comprises the amino acid sequence set forth in any one of SEQ ID NO: 1044 and SEQ ID NO: 1045.

4. The antibody or binding fragment thereof according to claim 1, wherein the antibody or binding fragment thereof binds to an epitope of *C. difficile* toxin A, wherein the epitope comprises the amino acid sequence set forth in any one of SEQ ID NO: 1044 and SEQ ID NO: 1045.

5. The antibody or binding fragment thereof according to claim 1, wherein the antibody or binding fragment binds the glucosyltransferase domain (GTD) of toxoid A.

6. The antibody or binding fragment thereof according to claim 1, wherein the antibody or binding fragment binds the glucosyltransferase domain (GTD) of toxin A.

\* \* \* \* \*